United States Patent 8,344,211 (PLANT NUCLEOTIDE SEQUENCES AND CORRESPONDING POLYPEPTIDES) - sequence listing, part 26

SEQ ID NO: 96219 - DNA, 1287 bp, Zea mays
  misc_feature: Ceres CLONE 1586725
  misc_feature (47)..(47): n is a, c, t, g, unknown, or other
  misc_feature (50)..(50): n is a, c, t, g, unknown, or other
  misc_feature (1035)..(1035): n is a, c, t, g, unknown, or other
  misc_feature (1119)..(1119): n is a, c, t, g, unknown, or other
aaaatagaatgaaaatatatgagcggcgttattttgttttttttgtncgntcttttgaggacgacccatactaaatttctaatccccgcgtggcggccgctctagactagtggatcccccgggctgcttgattcgtctcacccctagaaaaggcccccaccagagcagaggccgccacgcgctctcgtcccttctcaacccctccttctcctccgctccccccgcgcggcgcggaagagagaccaaaggggacggcagccaggaaggaagaggaggcttcgagatttttgcggaacccccacgccacccccctctgcacaccaccacaaccttctcctcatagcctgcctctcgcgtagggtttgcgcgcgccaccgtctccactccaatccagcaccacccgtcctaccgacgccgcattcggagctctgcatctgccagcaggccgattcgccaatcgcccccgagcctcgtagaagcctcggccgtaaccggtttgggggatttctgggttttcccttttctcaacggttaactggttgagtggggaaacagaagaaatgggatctgctattggagccgctaatactagttttcaggcccagaatttggagacggtggactatatttcaacgccttgaagagggagcgtttcgggagaatatgggcctgggcctgaaatattagagatttattccgggggcgcggtaccttctccctcatgagaaaagatagtgaaatactgtagtttgaaggatgtgaggcagatgtgactactagtaaggaggatcgatgacgcagagagagggtatagcaaccggagaccagtagtggtgattgtatcgtatcctattatatgataagtacatgcggaacgtgagatgatggatatgacggaactactataaccactctctacgagcggtccccacacaaaccgagtactccagagcgcggcgagattgggtagatctcggctctgagagatctccgttatcgaatatcctatgtcttgatatatagttttgcgcgtantacagtaccgctatgatcacttcggcagaataactgtttagtatatattagatgacaaaatacgtgagcgcataataacactanctaaggaattcgtacagagattcatctctaagtgcagatgtctatcagtactgaggccgaacacataaataatgatctgtcaactcacttgtacatatatcgtgcgaatatacgccccaggagtgatgttgatagcggtcagacgggtgctacacgaagcacatatgg

SEQ ID NO: 96220 - DNA, 860 bp, Zea mays
  misc_feature: Ceres CLONE 1586726
  misc_feature: Translation starting site: 122
  misc_feature (280)..(280): n is a, c, t, g, unknown, or other
  misc_feature (860)..(860): n is a, c, t, g, unknown, or other
ggagctccccgcggtggcggccgctctagaactagtggatcccccgggctgcaggaattcgtctcacccctagaaaaattcgcaccaccgccgcgccgcccaaatcacagccaccgccgccatggccgcctccagccgccctctcgtctccgtgaaagccctggagggcgacatggtcacggacgcccccggcatcgccttgccgcccgtcttcggtgcgccgatccgcccggacgtggtccgcttcacccacaagctgctgtcctgcaacaagcgccangccttacgcaggtctcccgccgcgctggccaccagacgtcgggcgagtcctggggtacgggccgcgctgtgtcccgtatcccccgcgtcccccggggcggcacccaccgcgccgggcaagggagcatttgggaaacttgtgccccgggcggaacccttgttccccccccaccaaaaatctggggcaaagtgggaacccccccccgttaaaggttaaacctctccccccgggttccccgtttccccttgggggggtttggcccgccaaaccgggcgtttctccgggggcccttttttttccagggggagggggcggggcccccccgcatttttggaaaaaccccgccccccccaaaaaaaatgcccccccggggggtattttttccccaaaactctgggggggggaggtcctctttttggggaagaaaaaaaccccccccccaggggggggctctaaaaaattttcctctcaaagcggggggtgggggggggcccctttacccccccaaaaacccccaaaagaaaagggggccaaaaggaatcttctcctgtggggggagataatccccccccccgcggan

SEQ ID NO: 96221 - DNA, 868 bp, Zea mays
  misc_feature: Ceres CLONE 1586727
  misc_feature: Encodes the peptide sequence at SEQ ID NO. 96222
ctccccgcggtggcggccgctctagaactagtggatcccccgggctgcaggaattcgtctcacccctagaaaaaatcagaccgccagcagtcgccagcccagcaaggcagagcagcgagcggctatgggaagagaggcgccggcgatggcggtagcgctgctggcggcgctagtcgcttccgcggccatgttggcggggaccgcgagcgcgtccccggcggaggggatccagccgctgtccaagatcgccgtccacagggccaccgtcgaaatgcagccgtcggcgtacgtgcgggcggaaacggtcgctcctcggggagaagggagaaaaccccgagtgggtggacggggaaaatttcggctggaaaaaaacccgccaaaggaaaaatggggattgggggtttttccccccgccgggaattaaaaaccccgcggggggtaatttgtgccaaaacccccgggggggcccggaaaaaaaaacccctttttttttttgggggggggcccccccctaaaggggtttttttggccccccacaaattttctttgtggaaaaaatatttttttttttggggggggggaggggggggtaaaccccgggtgggggggattattttaaaaaaaaagggggggggacgataatttttttctttttggcgcccccctctttgaggggggggggggggggttttataaacccaaataggcggtgtttttttttttgcggggggggggggaagcccccccctttcttttttttttttaataaaaaacacaacggaggggggcgggctgttgtttttttctccccccccgcgggggaggggggggggggggcctcccccctcaacaaaaaaaagaaagatgg

SEQ ID NO: 96222 - protein, 92 aa, Zea mays
  misc_feature: Ceres CLONE 1586727
MAVALLAALVASAAMLAGTASASPAEGIQPLSKIAVHRATVEMQPSAYVRAETVAPRGEGRKPRVGGRGKFRLEKNPPKEKWGLGVFPPAGN

SEQ ID NO: 96223 - DNA, 952 bp, Zea mays
  misc_feature: Ceres CLONE 1586728
  misc_feature: Encodes the peptide sequence at SEQ ID NO. 96224
  misc_feature (9)..(9): n is a, c, t, g, unknown, or other
  misc_feature (15)..(15): n is a, c, t, g, unknown, or other
  misc_feature (31)..(31): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
tttcctacntttccnttatcacacccacatnaataaataatttaaactaataaaagctgagaaagagagcacnnnnnnnnaaagctggaactccccccggtggcggccgctctagaactagtggatcccccgggctgcaggaattcgtctcacccctagaaaaatcagaccgccagcagtcgccagcccagcaaggcagagcagcaagcggctatgggaagagaggcgccggcgatggcggtagcgctgctggcggcgctagtcgcttccgcggccatgttggcggggaccgcgagcgcgtccccggcggaggggatccagccgcagtccaagatcgccgtccacagggccaccgacgaaatgcagccgtcggcgtacgtgcgggcgacaccgtcgctcctcggcgagcagggagaagacacccagtgggtgacggtgaagttccgctggaaagaaccgcccgaggacgactggatcggcgtcttctctccgtctgaattcaactcgtcgggtacaggtccgaacccatggccagcagaagaaccctatcgctgcacagcacccatcaagtatcagttcgcacactacttctgcgaactacatctactggggcaagggcagcatccggctgcagactcatcaaccatgcgatacgacttcctccttcggccctctttcacggatgggcctcaacaaacccgaggattggatccgcaggtgtccggagccccattatgggtttcaagaaaacccccaaggcgccccggtggttccccccgcccccggcaaccaaggccacgttccccaccaaccaagaatgaacgggtggaacagtggaaccccagcggggggtacctccctatcctatggagggccgataacaccttttcctttggaaaaagggggggtccccccggggaattcacccgtacaaggaaaggcgtccccccgt

SEQ ID NO: 96224 - protein, 239 aa, Zea mays
  misc_feature: Ceres CLONE 1586728
MAVALLAALVASAAMLAGTASASPAEGIQPQSKIAVHRATDEMQPSAYVRATPSLLGEQGEDTQWVTVKFRWKEPPEDDWIGVFSPSEFNSSGTGPNPWPAEEPYRCTAPIKYQFAHYFCELHLLGQGQHPAADSSTMRYDFLLRPSFTDGPQQTRGLDPQVSGAPLWVSRKPPRRPGGSPRPRQPRPRSPPTKNERVEQWNPSGGYLPILWRADNTFSFGKRGGPPGEFTRTRKGVPP

SEQ ID NO: 96225 - DNA, 844 bp, Zea mays
  misc_feature: Ceres CLONE 1586730
  misc_feature: Encodes the peptide sequence at SEQ ID NO. 96226
  misc_feature (491)..(491): n is a, c, t, g, unknown, or other
ctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcancagggtgaggagaagcagtttgcagctgaagagatctcctctatgggtcttatcaagatgcgtgagattgctgaagcataccttggtagcacgatcaagaatgctgtggtcacagtccctgcctacttcaatgactcacggaggacagccacaaaggatgcttggggtggatgctggccctaaatgtgctgcgtatcatcaacaagcaagcagctgcagctatcgacttatgtcttgacaaagaagctaccagtggcggtgaagaagactgtcttcactttggatcttggaggggggacctttggatgtctccctcgccacccttgagggaggcatcttttgagggtcagggc

SEQ ID NO: 96226 - protein, 171 aa, Zea mays
  misc_feature: Ceres CLONE 1586730
  misc_feature (9)..(172): Pfam Name: HSP70 Pfam Description: Hsp70 protein
  misc_feature (111)..(111): Xaa is any aa, unknown, or other
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVISGPGEKPMIVVQXQGEEKQFAAEEISSMGLIKMREIAEAYLGSTIKNAVVTVPAYFNDSRRTATKDAWGGCWP

SEQ ID NO: 96227 - DNA, 952 bp, Zea mays
  misc_feature: Ceres CLONE 1586736
ctccccgcggtggcggccgctctagaactagtggatcccccgggctgcaggaattcgtctcacccctagaaaaatcccagatcaggattagccgaccacccgccgaaggccagagagaaatatctcatcttctctccaccggatcggttcaatcgagagcgagggagaaagggaggtggtgcgtcgaggggggccgagattttgccggtttggagccaaataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcgtgttcgtggtccttttgcgctttctcgtcccttctttctctcaatccctccttattcttctccttccacggcgaagcccggcggcttggtatggatccccaagggccctcaaaactgggagggccttttgcttcccgacccatcgagaaggggggggcacgtcgccctccccttccgtccattggcattccggcggggtgggcttctccggggcgtttgcagcctggcccgtgtgcccttcctccaaatcctttcctatttaaggggtgaactcggtttttgggaaacccgagaaaattccgtttttgggggggggggccttttccttacccggataaaccccggtcggggtgtcccccaattttgattgtgggggggccctcattgtgcttccacccgggtgtgggtcacggggggaaattcccccgggggccccgtttggaaaaaaactttaccgttggggggcgggaggtttattctccccccacaggcggattgtaaacaccctatattcctcgtgtaagattcagcgcaattcagaaaaagctatagtcttctctttt

SEQ ID NO: 96228 - DNA, 824 bp, Zea mays
  misc_feature: Ceres CLONE 1586743
  misc_feature: Encodes the peptide sequence at SEQ ID NO. 96229
ctccccgcggtggcggccgctctagaactagtggatcccccgggctgcaggaattcgtctcacccctagaaaaagactctcgcatcccggattgttccgccgcccgcacacgtctctcctcttccgttcctctcctgcctccagctctccacggtctctgacccgcacaactgaacccgcgatggcgcgccgcctcctcgtcgccctcctcgccgcgtcgctcctgctcccgctcgcccgcgcggactcctcctcgtccccgcccgacaccaccgcgtacgacgagctccgcctccggggcttcccgcgcggcctgctcccggccaacgtgcgggcctacacgctcgactccggctccggggacttcgccgtcgacctccgctccagctgccggatcgtgctgcccgcggggagctacctcgccgccttcagcgaccgcctcacgggccgcctcgacgaccgccgcatctcgggcctcgacggcatccgcgtcagggccttcttccgctggtggtcatcacggggatccgcgccgatggggaccagctcgtcttcgaggtcggctccgtctccgccaaagtccccggcgcggaacttcacgccaggctcgactgccccgcccaggcggcgtccctagtcaagggaggtattaaatacttgcgtacgggtggctcagcgccttccgttcaataactttggggtttcaagggtttaagttttttattggcaactggtctggcttggtgttttttcccccggaatttcccggacaccttcggaacttttttgtgcccaggggtttttgttttttaccgggttttaat

SEQ ID NO: 96229 - protein, 151 aa, Zea mays
  misc_feature: Ceres CLONE 1586743
  misc_feature (4)..(139): Pfam Name: DUF538 Pfam Description: Protein of unknown function, DUF538
MARRLLVALLAASLLLPLARADSSSSPPDTTAYDELRLRGFPRGLLPANVRAYTLDSGSGDFAVDLRSSCRIVLPAGSYLAAFSDRLTGRLDDRRISGLDGIRVRAFFRWWSSRGSAPMGTSSSSRSAPSPPKSPARNFTPGSTAPPRRRP

SEQ ID NO: 96230 - DNA, 843 bp, Zea mays
  misc_feature: Ceres CLONE 1586745
  misc_feature: Encodes the peptide sequence at SEQ ID NO. 96231
ctccccgcggtggcggccgctctagaactagtggatcccccgggctgcaggaattcgtctcaccccccctagaaaaaaacccaggcaacacagcaatcagcagaaaaacatctccttggccttccatccatatgatccatccctccaggctccagctaactccaaactaccctctggttcgactcgcgttcgcatcgcaagcagcagcgtaccatcgaggcaatggcggtgatggccgaagtagtgtcgaccaccggcgcggcgctccggagcccggccacgcagcagccggcggcggcgggcgcggcgaagggcaccgacgctgagaagctccagttcatcgaggacatgacctccaacgtggacgccgtgcaggagcgcgtgctgggggagatcctcgcccgcaacgcggacaccgagtacctctccagcaggtgcggcctcgccggcgctacggaccgcgccaccccttcgcgcaaggtgccgatggcgacgtacgaggacctgcagccgtacatccggcgcatcggcgacggcgaccgctcgcccatcctgtcggggcacccggtctccgagttccttaacaagctcggggacgttcgggggggaaacgggaagctcatggcccacccatcgaaggaaaaagctaaacccggcggccagatggtgtggtaaaaccccccccaaagagcccccccataaaaaccctttaagtgctcctgggggagggaaaagggggaaaaacccccccccttttctccgggttccccaaaggggggagaaaaaaaaaaaaccgggggggggtctcccggggggaaagggccccccctccctaaaaaaaaa

SEQ ID NO: 96231 - protein, 150 aa, Zea mays
  misc_feature: Ceres CLONE 1586745
MAVMAEVVSTTGAALRSPATQQPAAAGAAKGTDAEKLQFIEDMTSNVDAVQERVLGEILARNADTEYLSSRCGLAGATDRATPSRKVPMATYEDLQPYIRRIGDGDRSPILSGHPVSEFLNKLGDVRGGNGKLMAHPSKEKAKPGGQMVW

SEQ ID NO: 96232 - DNA, 887 bp, Zea mays
  misc_feature: Ceres CLONE 1586748
  misc_feature: Encodes the peptide sequence at SEQ ID NO. 96233
  misc_feature (550)..(550): n is a, c, t, g, unknown, or other
tggcggccgctctagaactagtggatcccccgggctgcaggaattcgtctcacccctagaaaaaggcgtggcgcgacggcggcggtcggtctggcagggctcccctcctttccaccagatcagaacagatagtcatagatcagtgtcacaccacgacccgccagacggaccgccacttgccaaccaacgcctttgcctcctcctccgcctccgggcgctagcgggaatggacgccaccgagctgcgcctcgtctaccacctcggtctggagatggccgcgatctgggccgccgacgccgtcggcttccacggctccctcctctacctcctcgccttcctctacctctacatggtaaatgctcactgtgcagtgagactgcggaagatgatacaacatgaagagatgaaatctgcctaccaacgaaggctcctctctgatgcagaatcagcacgctggttaaaccatgcaatcgacaagatgtggcctgactgtatggagaaagatcgttcaaaacttctacagcccatcataacatgggttcgtgggatnagttcaaacctatggaccggcaccaaagcaaggtattcgggaacttttcatggggcagggaaccgccaattctttaccctccgagtagaagttcgacctggagacctccggaagatgagccttttgggtctttggggcgggggatgtgaatttatcttttccgcggaaaaaaatgggagggctggtactatgctaaggaaggctgcccaaaaaagggggggggacttgggaaatggacggccaaaaaaatgccctttaaacaaacccctcccttgttccaggggaaaaagaaaatataggtgggggcggggaaaatattttgtttcggggaggaggg

SEQ ID NO: 96233 - protein, 220 aa, Zea mays
  misc_feature: Ceres CLONE 1586748
  misc_feature (108)..(108): Xaa is any aa, unknown, or other
MDATELRLVYHLGLEMAAIWAADAVGFHGSLLYLLAFLYLYMVNAHCAVRLRKMIQHEEMKSAYQRRLLSDAESARWLNHAIDKMWPDCMEKDRSKLLQPIITWVRGXSSNLWTGTKARYSGTFHGAGNRQFFTLRVEVRPGDLRKMSLLGLWGGGCEFIFSAEKNGRAGTMLRKAAQKRGGDLGNGRPKKCPLNKPLPCSRGKRKYRWGRGKYFVSGRR

SEQ ID NO: 96234 - DNA, 1257 bp, Zea mays
  misc_feature: Ceres CLONE 1586749
  misc_feature (1)..(1): n is a, c, t, g, unknown, or other
  misc_feature (13)..(13): n is a, c, t, g, unknown, or other
  misc_feature (44)..(44): n is a, c, t, g, unknown, or other
  misc_feature (45)..(45): n is a, c, t, g, unknown, or other
  misc_feature (47)..(47): n is a, c, t, g, unknown, or other
  misc_feature (1164)..(1164): n is a, c, t, g, unknown, or other
  misc_feature (1205)..(1205): n is a, c, t, g, unknown, or other
ntgttgggggttntgggggtccgtcgccgtcccccttcttttgnntntgatggagttttatcgtgtaatttgaaaaagttggaactccccgcggtggcggccgctctagaatagtggatcccccgggctgcaggaattcgtctcacccctagaaaaacctccaccaccagaagaaaaaaccaaggcggagggcggagaggagagcaaggagggtgaagggggaaaagggtaataaaaataaaagaggagaggcgaagcaagacgaggaggaagagggagcacccagaggcaggggagggggaataattccgcaggggctgagggatctcggcgagtccggccggggagcagcgcaccgaggcggcgatcggaggcgggcaggcgtagacgccggcgagatttgtgttggtgacaaaccatgaacggggcaacccccgttgttaattaaccctcctgttaacttgaagcacccgaaagcgaaaaccaaaaattggttgtcccaaaaaagggcccctctccaaagttggaaggctttcccgggggaggcccaatttccccggaaaattcccccccgtttccccaaattctctccgaggggggcaaaaaaaattccgttccagggaaataaaagggagggccccttaaaacccccccccccccaagataggtccaggacatttttcagcaccttactcctgccccaaaacgggtgtgggcccgggaggaaaaccccctgccctcttaaaatataaaacagagcggtttgtggcctctccttacgcctctgggggggggacaactactctttacgaccacaccccgttggtggggcgccccgccccagaggtgtttttttttggagaaatggacgcctaaccactcccctcaacaaaagaagagaaaatatgctcgccccccgtttttgtggacaaaagaaaacagtgcacaagtatatgtgtgggtgctcatccgcggcgccaaaataattgtctatgtagcctcttttgttctccgtaccccattatgtaatggtgtgtttgcatacatctctactctaagtgacttgcacatcttggtcacgtatctgagcaagagagtggcacaacatttttttttctccccggcagacaaaaagatatatggggttcctctcaccacacaccncgggcgtgcgcggtaataaaaaaataaatggttatcttccntgaaaagattagagtgagaacctcctcacatatcggcgagtgcatcactctt

SEQ ID NO: 96235 - DNA, 768 bp, Zea mays
  misc_feature: Ceres CLONE 1586751
ctccccgcggtggcggccgctctagaactagtggatcccccgggctgcaggaattcgtctcacccctagaaaaaatctgcgagagtttcatttgggggctctaaaatagcctcaccctcctcgtgccttatcttcatctcacctgctctttctcctccgtgctgatcggcagtctctaagctttgcaacaactgatagccgaattccgcgcgccggtccctaaaaaaatgcaagtactaggaagtagataagatgcatttccctgtaatttttcgttattatatatactcagcacgggaaggaggggagacactctgttcaaccaccagccgagttcgcagcggcactccagggtccaggcccagcagcctcttcggctcttcgttgggggtgcgtggacaccggaaattgcctcggggaatgcgttcctgatctaagcccggcatgaagggctgctcagagcgtttgctgctcctgctgctgctggcatcgtcgttgttactgtccgtctgggttgcccgcaacaaacttgcctggccaactcgaaagcaaatgcgacgggggccccctgatgactggggagggggatttcttccccgggggtcccgaaaattaagttttggagggccaacaaagcaaaaaaccctctttggttttaaaggggggttaaccggggggggaaatctttttctcggaaaaaaaaaaaaaaaagactgggaaagcccccttccagggttggggttttgggaaaaaaattttccgggggga

SEQ ID NO: 96236 - DNA, 921 bp, Zea mays
  misc_feature: Ceres CLONE 1586752
  misc_feature (595)..(595): n is a, c, t, g, unknown, or other
  misc_feature (676)..(676): n is a, c, t, g, unknown, or other
  misc_feature (711)..(711): n is a, c, t, g, unknown, or other
  misc_feature (763)..(763): n is a, c, t, g, unknown, or other
  misc_feature (789)..(789): n is a, c, t, g, unknown, or other
  misc_feature (796)..(796): n is a, c, t, g, unknown, or other
  misc_feature (812)..(812): n is a, c, t, g, unknown, or other
  misc_feature (892)..(892): n is a, c, t, g, unknown, or other
ggagctccccgcggtggcggccgctctagaactagtggatcccccgggctgcaggaattcgtctcacccctagaaaaactctctctcctcgaacacagacacggatacaccattgtacatgctcgctcttcctcttggagtcttgggaccgccccctcccctcttccgagtctgatccctccttccttccgtcagcgcacatctctagggttttagcgccccatttccgcatcgccattcccgatcggatcgcccccttcccacccgccgcccgacagatcccggcgcgagtgctacccaaccctccggcgccccccacccttagtctcagaggggtcggtctcccccgaaaagctttcgcaaaaaatccccctcccttttgccgggggccccttttgttggcaaaaatttggggtttttcccccccccaacccgggggcccccggggtttttttttttttgggcccgcccccccccaaaaaaaaggcccccccccccttttttttttggaaagaaaaaccctccccccccggtttttttttccccccacaggagtttggttttatttcccccctcccccccccccccccctctnatttttgtgggcgccggggggggggaaaaaaaaaaattatttttctttttcttcttccggggggggggggggggggggggnaaaaaaaaaacaaatcccccctctcccccttcctngggggggggggggagaagaagagagagtatttagtttgttttgtggtctgcnccgcgcgcgggctggtgtggtgtctngattgtntggggtgtccgcttcnctaggtgggggcgaacgaacacaaacccagcacccggcggagcccgccgggggggcggcgcttctcgtcggctcccgccnttgacgcaggaggatagatataagagaag

SEQ ID NO: 96237 - DNA, 1049 bp, Zea mays
  misc_feature: Ceres CLONE 1586754
  misc_feature: Encodes the peptide sequence at SEQ ID NO. 96238
  misc_feature (1)..(1): n is a, c, t, g, unknown, or other
  misc_feature (17)..(17): n is a, c, t, g, unknown, or other
  misc_feature (58)..(58): n is a, c, t, g, unknown, or other
  misc_feature (66)..(66): n is a, c, t, g, unknown, or other
  misc_feature (67)..(67): n is a, c, t, g, unknown, or other
  misc_feature (69)..(69): n is a, c, t, g, unknown, or other
ntttttttttttttttntttttctactatatccttctctacttcctatttttcttttnccctttcnnanaaaaactggagctccccgcggtggcggccgctctagaatagtggatcccccgggctgcaggaattcgtctcacccctagaaaaaaccagcaacccccaacagcgccactgtccagtgcgcgcgtcaagcttgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacgttcgcgggctcgttcaccaagagaggtctgctgctcaagttccctgctgcggggcggcgggctcacttctgggcctacgtcagcggcgtccggcgtcaccggaaccctcctgccgaattaaagaggggaaccttcagggagcccgccgcaagcccggggccccgcggcggggaaaagattttaaagcttcaagctttcctccatttttgcaatggggccaaaaataggcctttggccttttggtaacctggccaagcccgcccgggatccaattccccttccccaaattcggtcaaggggaaatcaacccccccccaaaaccttgggtgggtaaacccccttggttcacaaaaattttgggataatatttggcccattttccgccaaaatggggtgaacctccctttggggccttcccttaccaaaatatttaaaaatgggggcttttgcggggggcccttctccttttaaaaaaaatataggaagcgagaggtgtgtaagaagagatggagagacctcccgcccccctttgtaagaccgcgaaaggcctcctgagtgccctctttt

SEQ ID NO: 96238 - protein, 170 aa, Zea mays
  misc_feature: Ceres CLONE 1586754
  misc_feature (5)..(149): Pfam Name: PSI_PsaH Pfam Description: Photosystem I reaction centre subunit VI
MASLAAVSVKPVAIKGLAGSSISGRKLAVARPSARSIRRPRAAAVVAKYGDKSVYFDLDDIGNTTGQWDLYGSDAPSPYNPLQSKFFETFAGSFTKRGLLLKFPAAGRRAHFWAYVSGVRRHRNPPAELKRGTFREPAASPGPRGGEKILKLQAFLHFCNGAKNRPLAFW

SEQ ID NO: 96239 - DNA, 1088 bp, Zea mays
  misc_feature: Ceres CLONE 1586758
  misc_feature: Encodes the peptide sequence at SEQ ID NO. 96240
  misc_feature (59)..(59): n is a, c, t, g, unknown, or other
  misc_feature (60)..(60): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (999)..(999): n is a, c, t, g, unknown, or other
ggggggggggggggggggggtaggggggggggagggaccaccgggccaaccccaaacanntnnnnntttttaattttcaaaactggaactccccgcggtggcggccgctctagaactagtggatcccccgggctgcaggaattcgtctcacccctagaaaaagttgcaccagctcgcatggcgctccacgccgtctcccccgcggcggtctcctccccgctgcgcgccctctcgcgcagattcccccagcgctcaggctgtggttgtttaccaaagcagtccgtcacaatttgctcctctacgaactttgcaagaaaacttcaggatggaccagtggacttcgctgccaggcgactggttcttggacactcggacaagagagcagttttgacgcatgccactattgaagaaatcgaagcggagaaatccctcgtcgaagaccaagctaaagaaaagatggagaaggcgatcgaaacagtccaaactaacttcaacactgtgaggacagggcgtgcaagcccggcaatgcttgaccggaatcgagggtcgagtactaccggaactccagtgaaacttgaaagagcaattgcacaagataagcaactcccagatggcaaacttcctccttccttaattcaaacccttatggattaaggtcaaagccctccaaggcttttatttgaagaaaaaaacctattaggtttggcccgccaaaaaatccttgtggggggttggaccacccccaaagccacaaatgggacccggggaataaaaagttggtaatatacccaaaggtgggaactgtgggtccccccaaccccggtttaggaaaaattccttcaaaatcccccacaaaaaaaggacagaattttggccccaaaaagaaacacgggggcggcctaaaaattgttggcgcttagaaaagaatggggcgccaagagggtttcgtctctttttatggggggaacacccttattgagaaaagaaaattctctccantcccaaaagagctttttcgcggataaaaaaccccccccacaagaggggaaaaaaaaaagcctctttctttctataaagaaaaaaaagtt

SEQ ID NO: 96240 - protein, 158 aa, Zea mays
  misc_feature: Ceres CLONE 1586758
MALHAVSPAAVSSPLRALSRRFPQRSGCGCLPKQSVTICSSTNFARKLQDGPVDFAARRLVLGHSDKRAVLTHATIEEIEAEKSLVEDQAKEKMEKAIETVQTNFNTVRTGRASPAMLDRNRGSSTTGTPVKLERAIAQDKQLPDGKLPPSLIQTLMD

SEQ ID NO: 96241 - DNA, 2017 bp, Zea mays
  misc_feature: Ceres CLONE 1587253
  misc_feature: Encodes the peptide sequence at SEQ ID NO. 96242
gcggcgtctagtcatcagatcattatccgcaccgacttgcgtgcacgagcttcgcggcgagggcagcaccggggctgggaatgggaagacactgcagcccagctccagcagcactacagcagtagcgccaccgaacctgaaaactccgaccccccacgaaatcgcggaacctacccacgagccgagccatgctcagccgactcgccgcggcgaggcgacagctactgctatccccggccgtcgcgtaccgctcctcctcggcagcggcgacggcgtcggcggtccacgagagagcagcgcccgcctcggcctccgtgctcccggacaccctcgaaaggggctccgacgcgtaccagcgcaacacggccgccgtcggcgggttgctctccgacctgcgcgcccgcgtctcccaggtgctgcgcgggggaggcgccgaggcggtgaggcggaacgcggcgcgggggaagctgctcccgcgggaccgcatcgaccgactgctcgaccccggcgcgtccttcctcgagctctcgcagcttgcaggctcagatgtttatgatgaagcattaccatcagcaggtataataactggcataggacctgttcatggacggttatgtatgtttgtggccaatgacccaaccactaagggtggcacatactatcctcttactgtcaagaagcatctgcgagcacaggaaatagcttcggagtgcaaactgccttgcatatatctcgttgacagcggaggtgctaatctccccaggcaggctgacgttttccctgaccgtgataattttggccggatattctacaatcaagctaagatgtcttcagatggtatccctcagattgcagtagtcttgggttcttgcactgctggtggggcatatattcctgcaatggcggatgagagtgtaatagttaagggaaatgggactatatttctagcgggtccaccacttgtaaaggctgctacaggagaggagatatctgctgaggaccttggtggagcatcagtacattgcaaggtatcaggagtctcagatcattttgcacaagatgaaattcatggacttgagttggggcgaaacattgtgaagaacctgcacttagctgctaaaggaacaaatattcagagttctgcttgtggttaccaagagccattgtacgatgtagaggaacttcgctccattgcaccagctgatgtgaaacagtccttcgacattcgttcaataatagcccgtattgttgatggaagtgaatttgatgagttcaaaaaattgtatggaacaacactagtgactggttttgcaaggatatgtgggcaaccagttggaattattggaaacaatggcattttgtttacagagtcagcgttgaagggctcccacttcattgaattgtgcgctcagcggcatattcctttgattttccttcaaaacattactgggttcatggtcggatcaaagtctgaagctagtggaattgccaaagctggagcaaagatggtcatggcagtttcctgtgctaaggttcctaaaattacaataattgttggtggaagttttggggctgggaattatggaatgtgcggacgtgcatatagcccaaactttttatttctttggccaactgctaggatatctgttatgggtggcatccaggcagctggagttctcgctcaaatagaaaagaacaacaaaaggagacaaggagtggagtggagcaaggacgaggaagaagccttcaaagccaaagtcgtggaggcttacgacagagaaggaagcccgtactactccactgctaggctatgggacgacggggtcatcgaccctgctgacaccaggcgggttctgagcctctgcctctccgcttcggccaagccggttccggaagacacaagatacggtgtattccggatgtgaataaatgtgtgtgagtaataacgcagacgtgtttaataaaaagctgcctgcacgcacccaatgtgtgtgcacaaaaaaaaaaaaaaaaaaaa

SEQ ID NO: 96242 - protein, 578 aa, Zea mays
  misc_feature: Ceres CLONE 1587253
  misc_feature (83)..(576): Pfam Name: Carboxyl_trans Pfam Description: Carboxyl transferase domain
  misc_feature: SWISSPROT Homolog: EC 6.4.1.4 Methylcrotonoyl-CoA carboxylase
MLSRLAAARRQLLLSPAVAYRSSSAAATASAVHERAAPASASVLPDTLERGSDAYQRNTAAVGGLLSDLRARVSQVLRGGGAEAVRRNAARGKLLPRDRIDRLLDPGASFLELSQLAGSDVYDEALPSAGIITGIGPVHGRLCMFVANDPTTKGGTYYPLTVKKHLRAQEIASECKLPCIYLVDSGGANLPRQADVFPDRDNFGRIFYNQAKMSSDGIPQIAVVLGSCTAGGAYIPAMADESVIVKGNGTIFLAGPPLVKAATGEEISAEDLGGASVHCKVSGVSDHFAQDEIHGLELGRNIVKNLHLAAKGTNIQSSACGYQEPLYDVEELRSIAPADVKQSFDIRSIIARIVDGSEFDEFKKLYGTTLVTGFARICGQPVGIIGNNGILFTESALKGSHFIELCAQRHIPLIFLQNITGFMVGSKSEASGIAKAGAKMVMAVSCAKVPKITIIVGGSFGAGNYGMCGRAYSPNFLFLWPTARISVMGGIQAAGVLAQIEKNNKRRQGVEWSKDEEEAFKAKVVEAYDREGSPYYSTARLWDDGVIDPADTRRVLSLCLSASAKPVPEDTRYGVFRM

SEQ ID NO: 96243 - DNA, 2029 bp, Zea mays
  misc_feature: Ceres CLONE 1587291
  misc_feature: Encodes the peptide sequence at SEQ ID NO. 96244
aatcagatccatcaacacccttaccctaacataactaagtaaccgcctccctcctccactcaaccatggcggcgtctggcgacggcgacgtcgacatcgacgggtgctgcgggggcacgctgttcccagagaagtcgttccggagctggtcggcgtatgggcaggcgctgctggagacgggcccgcggctgcgcgaccgggtgacgacgcggtccatggacgacacggaggtgaacgaggtccgcggccggagcggcgccgacatgcggcggacgctcacgtggtgggacctcatctggttcggcatcggcgccgtcatcggctccggcatcttcgtgctcacgggccaggaggctaagaatgccgccggccccgccgtcgtcgtctcctacgccatctccggcgtctgcgccatgctcgccgtattctgttacaccgagttcgccgtcgagatccccgtcgcaggcgggtcgttcgcgtacctccgcgtggagctcggcgacttcatggcgttcatcgcggcgggcaacatcctgctggagtactgcatcggcggcgcggcggtggcgcggtcgtggacgtcgtacttcgcgacgctgctgaaccaccacccggacgacttccgcgttcacgccgccgcgctcgcggagggctactcgcagctggacccgattgcggtggcggtgacggcggtgatctgcgcgctggccgtgttcagcaccaagggctcgtcgcgcttcaactacgtgctctccatcctgcacctcgccgtcctcgtcttcgtggtcgtggcggggctgaccaaggccaatgccgccaacctcaccgccgacttcgcgcccttcggcgcgcgcggggtgttcgccgccgccgccgtgctcttcttcgcctacatcggcttcgacgccgtgagcaccatggcggaggagacgcggaaccccgctaaggacatccccgtggggctcatgggcgccatgacgctcaccaccatcatctactgcctcctggcactcgttctctgcctcatgcagccctacaccgagatggaccccgacgcgcccttcagcgtcgccttcaccgccgttggcatggactgggccaagtacatcgtcgccttcggcgcgctcaagggcatgacctccgtgctcctggttagcgccgtcgggcaggccaggtacctgacccacattgcgcggacgcatatggtgccgccgtgcctcgcgcaggtgcaccccaggttcggcacccccgtctacgccaccatcgtcatgatggtggccacggccgtcatcgcgctcttcaccaacctcaccatcctctccaacctgctctccatctccacgctcttcatcttctcactcgtcgccatcgcactcctcgtccgccgctactacgtctctggcgagacggcggcctcggaccgcaacaggctcgtggcgtgcctcgccgtgatcgtcgcctcgtccacggccaccgccgcgtactgggggatgacgacctccggtggcggcgggtgggtggtgtacgtggtcacttgcgccgcgtggctcgccgccacggcgtacctgcaatggggcgtgcccaaggcgcgcgcgcccaagatgtggggggtgccgctcgtgccatggctaccgtcggcgtccatcttcatcaacatcttcttactgggctccatcgacggcgcctccttcacgcgcttctggatatggacagcggcgctgctcgtctactacttcttcgtggggctccacgcgtcctacgacacggccaaggccctcgctgtcgagaccgaggcagcacgggtggaggaaggtgcgcgcaagcctaccgccgcgaacacagcagacggcggctgccgcttcggctaaactaaacttaaacttagtagccttagagcttagctggttaatgaaattatctgttattactctatctatatatgattagtcgacgtgcatgtacaaagaaatatactgctagcttaataagttcacagtgttgaatttcgaagcaaaaaaaaaaaaaaaaa

SEQ ID NO: 96244 - protein, 600 aa, Zea mays
  misc_feature: Ceres CLONE 1587291
  misc_feature (75)..(516): Pfam Name: AA_permease Pfam Description: Amino acid permease
MAASGDGDVDIDGCCGGTLFPEKSFRSWSAYGQALLETGPRLRDRVTTRSMDDTEVNEVRGRSGADMRRTLTWWDLIWFGIGAVIGSGIFVLTGQEAKNAAGPAVVVSYAISGVCAMLAVFCYTEFAVEIPVAGGSFAYLRVELGDFMAFIAAGNILLEYCIGGAAVARSWTSYFATLLNHHPDDFRVHAAALAEGYSQLDPIAVAVTAVICALAVFSTKGSSRFNYVLSILHLAVLVFVVVAGLTKANAANLTADFAPFGARGVFAAAAVLFFAYIGFDAVSTMAEETRNPAKDIPVGLMGAMTLTTIIYCLLALVLCLMQPYTEMDPDAPFSVAFTAVGMDWAKYIVAFGALKGMTSVLLVSAVGQARYLTHIARTHMVPPCLAQVHPRFGTPVYATIVMMVATAVIALFTNLTILSNLLSISTLFIFSLVAIALLVRRYYVSGETAASDRNRLVACLAVIVASSTATAAYWGMTTSGGGGWVVYVVTCAAWLAATAYLQWGVPKARAPKMWGVPLVPWLPSASIFINIFLLGSIDGASFTRFWIWTAALLVYYFFVGLHASYDTAKALAVETEAARVEEGARKPTAANTADGGCRFG

SEQ ID NO: 96245 - DNA, 2198 bp, Zea mays
  misc_feature: Ceres CLONE 1587451
  misc_feature: Encodes the peptide sequence at SEQ ID NO. 96246
agtccgcactccgcacggccgcaccgcaccactcccgcacttccgcgcggcgcgcgctcggcttatcgacaccaccacggcaccgctacagcctacagctcgagagaggagggaaaaaaaatctcagccaccaccggcagccgcgggagcttcgcgtgcgccgcttgctcactgcccgcacacgtacgccagaacccctctctcccccctccttctgcagccatgctcctccacctgcttccgctctcctgccccgcgccgccgttccacctgcgcaggaccggcggctcgccgcgggtccgcgccggggatagggccaggacacgggggctccgggggacggacgtggagccggagacagcgccgcgaaggcgccgcagccgcgatggcgacgatcctcaagcggctgggagcggtggagacaccggggcgctgctggcgtcggtcaggaggcttctgctctccgaggcgcctgcggcggcggagggagacagtgaggaggagcagggacagttccccaagcgttgggccatcgtcttcctctgcttctccgcatttctactctgcaacatggaccgcgtaaatatgagcattgctattctgcctatgtccgcagagtttggttggaacccacagactgttggtctcatccagtcatctttcttctggggctacctcctaactcagatagctggagggatatgggcagatactgttggaggaaagactgtccttggttttggtgtggtttggtggtccatagctacagctcttactcctgttgcagcacatcttggcttgccatttcttcttgttgtgcgggctttcatgggaattggtgagggggttgcaatgcctgcaatgaacaatattctttcgaaatgggttcctgtatcagagaggagcagatcattgtctcttgtgtacagtggaatgtaccttgggtcagttacaggacttgcattttcccccttgctgatacataagttcggttggccatcagtcttcttttcatttggatccctagggcttgtttggttcacgacatgggcaaccaaggcatatagttccccacttgaagatcctggaatcagcgctgcagaaaagaagcttattgctagtcagagcacagcaggcgaacctgttaaaacaattccatggagattaatactatcaaaaccacctgtttgggcacttatagtttctcatttctgccataactggggaactttcattttgctcacatggatgcccacatactacaatcaggttctgaaattcaacctcatggaatctggccttatctgtgttcttccctggttcaccatggcggtttctgcaaatgttggtggttggattgcagacacacttgtcagcagaggagtatctgtgacaactgttcgtaagatcatgcaatcaatcggattcttggggccagcattttttctaactcaactaagccatgttaattcgcctgccatggcggtgttgtgcatggcttgtagccagggaactgatgcattttcgcagtctggtctatactcaaaccatcaagatataggccctcgatatgcaggtgtacttcttggtctttccaacacggctggggtcttagcgggtgtatttggcacagcagcaacaggatacatcttgcagcatggttcttgggacaacgtattcgagttatcagtagtgctttatctggtagggactttggtatggaatatattctcaactggcgagaagattcttgattgaagtgacaaactcatttcggatcgacaacttgacccctggacataatacacttcaagataacaaatgtgtcatcgcgcagcacgagaagtatcaacctctacatcccggatattaaattgcctggttgtgatgttgctctggtagagacgatttgaagcatatggaattatggatgagttgagcgatgcacccgttccgagcatgccactgtatattgtgttgagcataggtatcatgtacagcatggtagaaagattcgtcatacagagtagttttttttttacttgtacaattttcccctcttgaatagtttgttcctgtaacagcccgacgtagataaaaacaaggaaatctggggatgggggtactactaatgcaaacatttggtgaataaaaaaaaaaaaaaaaaaaaaaaaaaaaaagaaaaaaaaaaaaaaaaa

SEQ ID NO: 96246 - protein, 511 aa, Zea mays
  misc_feature: Ceres CLONE 1587451
  misc_feature (107)..(470): Pfam Name: MFS_1 Pfam Description: Major Facilitator Superfamily
MLLHLLPLSCPAPPFHLRRTGGSPRVRAGDRARTRGLRGTDVEPETAPRRRRSRDGDDPQAAGSGGDTGALLASVRRLLLSEAPAAAEGDSEEEQGQFPKRWAIVFLCFSAFLLCNMDRVNMSIAILPMSAEFGWNPQTVGLIQSSFFWGYLLTQIAGGIWADTVGGKTVLGFGVVWWSIATALTPVAAHLGLPFLLVVRAFMGIGEGVAMPAMNNILSKWVPVSERSRSLSLVYSGMYLGSVTGLAFSPLLIHKFGWPSVFFSFGSLGLVWFTTWATKAYSSPLEDPGISAAEKKLIASQSTAGEPVKTIPWRLILSKPPVWALIVSHFCHNWGTFILLTWMPTYYNQVLKFNLMESGLICVLPWFTMAVSANVGGWIADTLVSRGVSVTTVRKIMQSIGFLGPAFFLTQLSHVNSPAMAVLCMACSQGTDAFSQSGLYSNHQDIGPRYAGVLLGLSNTAGVLAGVFGTAATGYILQHGSWDNVFELSVVLYLVGTLVWNIFSTGEKILD

SEQ ID NO: 96247 - DNA, 1979 bp, Zea mays
  misc_feature: Ceres CLONE 1587482
  misc_feature: Encodes the peptide sequence at SEQ ID NO. 96248
gttccttccaactcgctcccaaatccagacgagaaaaagctccgcgtctgcggtttgattgcgctcgcgccccttccgaatcctctcgccaccccccgccgtcatggacgacgaccacgaccacgacgcgtcgtcgccggccgccggggagcggtgcccgtgctgctcctccccctcctcctcgccggccgtgccgtggcggcggtccgtgaagcggaagctgggcgcggagaagggggaggagggcggggaggcggggcccacggcgcgggtcgaggcggaggacgagtgcgcggcgctgcgggaggcggtggcggcggcccagtccacggcgtcggcgctgcgggccgaggtcgaggaggagcgcctcgccgcggccagcgccgccagcgaggccatggccatgatgctccgcctgcagcgcgacaaggccgaggtccagatggagctccgccagttccgccgcttcgccgacgagaagatggcgctcgacgccgcggacatcgaccagctgcgcgcgctcctcgcccagcgcgcgcgccgcctggtgcgcctccgcgccaggctccgcgagtacaggcgccagttcctccacctcggcatcccgctccccgagggcgaggacctcctgttcgcccagaccgccgccgaggaggaagaggacctactcctcctcgagggcgaggacggctacgccgatggcgatggcgatggtgatggagggtactaccctcagctccgctgcaacgacggggagtactactacgaggacgaggaggaagaagatgcggttgccctcgatctggagcgccggatctgccgcctcgagcacgatcaggaaactcccctgcttgagccaccccttcaggaagacgaagaggaaggcacccacctctacacagaagaggcgttgccggacttgtctgggcatgagcagggtggcctctatgctgatgacatgttatctgtggacggtgtggaagaactgagcgacctccacaatgacgatgaagagctgccagagtctcctactgctggccgtggtgatagggtggaagcaagcgaggctgatggtgttgacagtggcagtgatagggtatacaccattgacaaggtgcatcaaggtgagtctgcgcctattgcaagggtcatggataagtaccagggtgaggcggtggagccagacattaagaagctttacatgaggctggaggcactggaggctgatagggagtcgatgaggcaggcccttgtggcaatgcgcacagagaaggcacaacttgttcttctttgtgagattgcgcagcatcttgccaaggatggagttccagctggggtggggccaggtgtacaccgttcccctagaaaacgagcagttgggattgtagaaaggagattcacggaggacaagagggtggcactcctcaagacatattccgtggttgccttgtttaagtgggtcctcactttatttggcaagaaaaagaagctatctcaaagcaggtatacttttggcttatcaagtaataatgttggtttgctcctactcttggataagtgcccacggatccagaaaaccctcatgagaacaaagtaaaacctgccgaaaagaagcagcagcagcagctgtacaatgtaaataaatagctgtcagttgggaagtttgcatcggattgttttttttgttaatgctgggtggagccagagttcttttgattctttagttgatgattttctgatttcacatctttggtgatgaggatatgcgcgttggtcttgcaatcgttcaagtcacaaaaaagctattgctttgcttctttctcaccagcaagagctacaatgcatgtatagtaatacactggtggttggtttacttgcttgcaggttgatgagtgaatatttatgacttttagcttacatgtccaaactgcaaacttttgtaaaaaaatgttccttgtatccaaaaaaaaaaaaaaaaa

SEQ ID NO: 96248 - protein, 497 aa, Zea mays
  misc_feature: Ceres CLONE 1587482
  misc_feature (63)..(156): Pfam Name: DUF593 Pfam Description: Protein of unknown function, DUF593
MDDDHDHDASSPAAGERCPCCSSPSSSPAVPWRRSVKRKLGAEKGEEGGEAGPTARVEAEDECAALREAVAAAQSTASALRAEVEEERLAAASAASEAMAMMLRLQRDKAEVQMELRQFRRFADEKMALDAADIDQLRALLAQRARRLVRLRARLREYRRQFLHLGIPLPEGEDLLFAQTAAEEEEDLLLLEGEDGYADGDGDGDGGYYPQLRCNDGEYYYEDEEEEDAVALDLERRICRLEHDQETPLLEPPLQEDEEEGTHLYTEEALPDLSGHEQGGLYADDMLSVDGVEELSDLHNDDEELPESPTAGRGDRVEASEADGVDSGSDRVYTIDKVHQGESAPIARVMDKYQGEAVEPDIKKLYMRLEALEADRESMRQALVAMRTEKAQLVLLCEIAQHLAKDGVPAGVGPGVHRSPRKRAVGIVERRFTEDKRVALLKTYSVVALFKWVLTLFGKKKKLSQSRYTFGLSSNNVGLLLLLDKCPRIQKTLMRTK

SEQ ID NO: 96249 - DNA, 828 bp, Zea mays
  misc_feature: Ceres CLONE 1588078
  misc_feature: Encodes the peptide sequence at SEQ ID NO. 96250
ggatcttgacggcgaccacgctaccaggcactgacgccgtgaactagttagtcatagcccccccccccccaaatgcccctgaaatcccagtctcccaggtcccaaccaaggagccttgtgcccatcccwtccgtcgtcgtctggacatgcagggaggtgtgaggtgcgtcggcgggcggttgggcctgaccatcgacccggctggcgacggggaggcccccgcggagcgcgtggggcggttggtccgcgagagccccgtggtgatcttcgcctggcgcgggtgctgcatgtgccacgtgatgcggcagctgctggcggccgtgggcgcgcacgcgacggtgatcgagctggaggaggccgccgaggaggccgcggcgtcggccgccgccgccgccgccgtgccggcgctgttcgtgggcggcgcgcccgtgggcgggctggacgggctcatggggctccacctcagcggcctcctagtcccgcggctccgggaggtcggcgcgctctgcggctaggccgggccggggcggcgtcgtcacttgctggtggtctggtctctctgtcgatacacgggtacggtacggtacgttacgtaatttaggggaagctgagggggggttgtagcgaaaatggccgtgtgacgttttatacagacgtcgttgctagttctgtctgtgctttgctgtatggcgctggggccgggtgaggtggttggctaaagttgaagaactatgtgagaaatgcctgggtgtaactgtaattaatacgtttgtcctgcacgagtttgttaactgcgtccctggttctccccaaaaaaaaaaaaaaaaa

SEQ ID NO: 96250 - protein, 122 aa, Zea mays
  misc_feature: Ceres CLONE 1588078
  misc_feature (38)..(95): Pfam Name: Glutaredoxin Pfam Description: Glutaredoxin
MQGGVRCVGGRLGLTIDPAGDGEAPAERVGRLVRESPVVIFAWRGCCMCHVMRQLLAAVGAHATVIELEEAAEEAAASAAAAAAVPALFVGGAPVGGLDGLMGLHLSGLLVPRLREVGALCG

SEQ ID NO: 96251 - DNA, 760 bp, Zea mays
  misc_feature: Ceres CLONE 1588212
  misc_feature: Encodes the peptide sequence at SEQ ID NO. 96252
accgacggcatttgcatctgagttcctgattgttgtattccagtttcttctgtgagttttgtgggatcgcgaggaagaactagaaggatgtcgtgctgcggaggcaactgcgggtgcggcgccggctgcaagtgcggcagcggctgcggagggtgcaagatgtacccggacatggctgagcaggtgaccaccactacccagactctcatcatgggtgttgcaccgtccaagggcgggttcgaggcggccgccggagctgagaacggcgggtgcaagtgcggcgccaactgcacctgcgacccctgcacctgcaagtgagacgacggcgatgacgctgcagggcgtcatgggatcggaaggactcttttatcttaagctctagtataatattctagcagtgtcgtttgtgttttgttcgagtcagtcagacagtcagccgcgtgccatgggccatggcatagcatgccattgcctcgctctatctgctccatcgcctttttctagtggtggtactgatgggggaacgaataattgtaccgagatgttggcgccgtgtcgtgtcgtgtcctgtcctgtccttcctgggactcatctagctagcagtcagactgtgttgtgttgtgttgtgctgtgtgggccgagtgtgcagtacagcatcaagccatgccccctgttccatctgtgtgcgactttgtttgtgctgtgtcatctatctatctaactaatccatctatgctatcctctaaaaaaaaaaaaaaaa

SEQ ID NO: 96252 - protein, 76 aa, Zea mays; identical to SEQ ID NO: 6267
  misc_feature: Ceres CLONE 1588212
  misc_feature (1)..(75): Pfam Name: Metallothio_2 Pfam Description: Metallothionein

SEQ ID NO: 96253 - DNA, 759 bp, Zea mays
  misc_feature: Ceres CLONE 1588272
  misc_feature: Encodes the peptide sequence at SEQ ID NO. 96254
aaaccattcccctccgccccacctcttgtccagtgccccaaatgctggcgaccacctgcagccggccgccgtgcccgtgcccgtgcccgtgcgcgcggtcgcggcggctccccgcggcgaccttcggcggcaccagtagcgcgaagcgaagggcgccgaggagagcggcggcggcggtgcggtgcgggctgctgcccgtggacccgtgggcgccgacgatggactcccagagcgtggcgtcgcagctcttcgccgtctcgctcttcccctacctgggattcctctacttcatgaccaggtccaagaccgcgcccgggctcacgctcttcggtttctacttcctcctcgtcttcgtcggcgccaccacaaaagttcattatggtacctcactgtccaacgttgactggctgcacgggggcgctgaatcgctgctgactctcaccaacctgtttatcgttttggggctgaggggagccctgaggaagctggaggaagagggcacagacgagagcgtttctgaagcttctcaagaaaaaagttctgtctagatgggttcatcatcagtacccctgaaggtgcactcagtaactaggagtgcgctgtttttcttcttctgcagctcaactagctcgtagtgatgttttgggtgtaaggaaatctggcagatctactctctgcatactatgctgataagaaacaatgtacaggcatctccctgcattctgagtagtaccttcagctgtcaaaaaaaaaaaaaaa

SEQ ID NO: 96254 - protein, 168 aa, Zea mays
  misc_feature: Ceres CLONE 1588272
MLATTCSRPPCPCPCPCARSRRLPAATFGGTSSAKRRAPRRAAAAVRCGLLPVDPWAPTMDSQSVASQLFAVSLFPYLGFLYFMTRSKTAPGLTLFGFYFLLVFVGATTKVHYGTSLSNVDWLHGGAESLLTLTNLFIVLGLRGALRKLEEEGTDESVSEASQEKSSV

SEQ ID NO: 96255 - DNA, 812 bp, Zea mays
  misc_feature: Ceres CLONE 1588341
  misc_feature: Encodes the peptide sequence at SEQ ID NO. 96256
aatcttcgacgccccgccaccgcccacaccgcacacacggatagcataccataccaatctttgaggtttcatcaacaatcaatacaaaagcacacggtcgagaggatatgaggatagcaagaatcgcgatggctatggaggacggcggcggcgcgtcgtcgtcggtgcagcagatgcagccggcggcggccatggcgtacggccgcgtcgagccgccgccgttctggtccacgccgacgccgtacctcttcatcggtttcgcggttgtgatggcgctcatcgccgtggcgctggccatgctcctctgctcccgccgcaaggaggaggaaggccggcgcgccgccgaggcggctggggtcatgtttgtcgtgcgcgtgttgacgccgctcgacagggaggatgccatgcctaaggtgctcgtcgtgatggccgggcacagcgcgccctcgttcctcgccagcgccgcaccgtttgccagcttcactgaggctgccgacggggccgccaagccccagcacggccgtggcggcggcggcaaggagggcgccgccgccgtgtaggcttccttacccagccgcgtgcaagagacatatcgaaaccccctaaaagctggatcatcggagaagggcgaaaaaaaaaaactaaggacttgttcggttagctctcaatccatgtggattgagtgagattggatgggtttgaatcccaaacaagtcaaactttttttcaattttttccaatcctatccaatccatgtgtattgggaataaccgaacaagccctaagctgaatcatcaaaaaaaaaaaaaaaa

SEQ ID NO: 96256 - protein, 150 aa, Zea mays
  misc_feature: Ceres CLONE 1588341
MRIARIAMAMEDGGGASSSVQQMQPAAAMAYGRVEPPPFWSTPTPYLFIGFAVVMALIAVALAMLLCSRRKEEEGRRAAEAAGVMFVVRVLTPLDREDAMPKVLVVMAGHSAPSFLASAAPFASFTEAADGAAKPQHGRGGGGKEGAAAV

SEQ ID NO: 96257 - DNA, 851 bp, Zea mays
  misc_feature: Ceres CLONE 1590059
  misc_feature: Encodes the peptide sequence at SEQ ID NO. 96258
aaccaaaccgcgccacccagtgttctcactcaccaaccaaccgagcgacacgcctaggacggagcgcgcacatacctgcgacaccatgtcgacgacgacgacgacgatgaaggcgagcgacccggggtccgcgtggttcggcagcggcgcccgggcaccggcggcggcggcggggacgggccacaacgtgcggctcatcaccaccgcggtggccgcgttcgtgtccgtgctcggcctcgccctcttcctccacctctacgtctgccacgtccgccgccgcaaccggcgccgcgcggccgccatagccgccgcgctgccgaccacggccgcggcgccggcccccaagggcgggctggatcccgcggccatcgcggcgctgccgaccaccctctacaggaacgacgcggccgaggcgggcgccggctccgacgagtgcaccatctgcctcggcgccgtgcaggacggcgaggtcgtgcgcgcgcttccggcctgcggccacgtgttccacgtcccctgcgtcgacacttggctcgcgtcgagctcgtcgtgcccggtctgccgcgccgaggtggagccgccgccgccgacggcggtgggctcagctcggttcgtgcaggagaaagtgcaggacgctgtgaagcaggaagccggcagctccactccggaccgggggatcggtgcctgtgcgtcgctcatcaagatgttgagcagggagaggccggcgccgcgaaggccccagggcgcctacgccgacgccggggacttggacgacttggaacggcagcagtatgctgttgccgtgaataattaattactctattattttttttctctaaaaaaaaaaaaaaaaa

SEQ ID NO: 96258 - protein, 241 aa, Zea mays
  misc_feature: Ceres CLONE 1590059
  misc_feature (117)..(158): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MSTTTTTMKASDPGSAWFGSGARAPAAAAGTGHNVRLITTAVAAFVSVLGLALFLHLYVCHVRRRNRRRAAAIAAALPTTAAAPAPKGGLDPAAIAALPTTLYRNDAAEAGAGSDECTICLGAVQDGEVVRALPACGHVFHVPCVDTWLASSSSCPVCRAEVEPPPPTAVGSARFVQEKVQDAVKQEAGSSTPDRGIGACASLIKMLSRERPAPRRPQGAYADAGDLDDLERQQYAVAVNN

SEQ ID NO: 96259 - DNA, 568 bp, Zea mays
  misc_feature: Ceres CLONE 1590141
  misc_feature: Encodes the peptide sequence at SEQ ID NO. 96260
tcctctgccttgtcgatcatccatcgaccgcctcctgctcggcttcccaccccgcctgcctgcgttgcacaccagggaggagctcctccraccgaccggccatgagctaccaggctcctcctccgggcacctcagcctacccgccgccgggcacggcctaccctccgccaggccagccgcaggggtacccgccgccggcatacggcgcgcccccacccatggccgccggggggtaccctcccccgccgcaggaggactctaagggcggcaacaacggcttcctgaaaggatgcttggccgctctctgctgctgctgcatgctcaacatgtgcttctgagttcgtcgtcaggggctcagggcacggggatggcccccctagagtccaaaccgatctccatcatgcagtcaggcgaaaaamaatgcatggagctgttctttttttttccttcctttctgaatcatgacgatratacatctttgtttccgtttccatcctgtatatgctttcccgtgctatgcatggaaacttcactagctaccccaacaaaaaaaaaaaaaaaaacgaga

SEQ ID NO: 96260 - protein, 78 aa, Zea mays
  misc_feature: Ceres CLONE 1590141
MSYQAPPPGTSAYPPPGTAYPPPGQPQGYPPPAYGAPPPMAAGGYPPPPQEDSKGGNNGFLKGCLAALCCCCMLNMCF

SEQ ID NO: 96261 - DNA, 503 bp, Zea mays
  misc_feature: Ceres CLONE 1590244
  misc_feature: Encodes the peptide sequence at SEQ ID NO. 96262
acagcggcctcactaagtcaccatcaccacccgcaccacacacgagcacacgcgacgactgacaaggcgaggggagcaatcggcggcgatgggcggcggcggcgcacatggcggcaccacctacaagggcctctgcgccgtgatgtggttctgggttttctacagggctaagcaggatggtgctacgctcttgggtttgcgtcatccttgggagggacatgatgaccactctcatggtcatggacacgggcatgaggcatcatcatcgtcatcttcacattaagttccttactggctgcggacgatgtttggcatgttccaacaactaaagtttgagttaataaattctatcaccctgcatgggactcatgttgtttgcaactggtttagcacgaactggtcttgttactattgtgctaatgtatttgattcgaagtttcagttaatatgctgtggaaaagaatctggtgcacgttgatgttctttaaaaaaaaaaaaaaaaa

SEQ ID NO: 96262 - protein, 64 aa, Zea mays
  misc_feature: Ceres CLONE 1590244
MGGGGAHGGTTYKGLCAVMWFWVFYRAKQDGATLLGLRHPWEGHDDHSHGHGHGHEASSSSSSH

SEQ ID NO: 96263 - DNA, 586 bp, Zea mays
  misc_feature: Ceres CLONE 1590564
  misc_feature: Encodes the peptide sequence at SEQ ID NO. 96264
actgccccctcgcagacgagacgcgtggtagctagggttttggcctcgccgcgcacgcctcctgaagcttctagacgttcgaggaggaggaggggaggctcccgccgccgccgccgcagccatggcgtccaccaaggtgcagcgtatcatgacccagcccatcaacctcatcttccgtttcctccagagcaaagcgcgcatccagatctggctcttcgagcagaaggacctccggattgagggtcgcatcatcggattcgatgagtacatgaacttggtcctcgaagatgctgaggaaatcaacgtcaagaaaaacactcccaagacactgggccggatactcctcaaaggtgacaacataactttgatgatgaacagtggcaagtgaaagttcttatggcaggaacgatgtttggtgctcgcgttgagtatttctggcacgttgtactccatccattcagacttacatgtacctgctgttaatgacctgagtaaaattatgctagatgctggccacttgtgtgtgccatattggcatcttttctgttttcctgttcagcttaaaaaagaaaaaaaaaaaaaaaaa

SEQ ID NO: 96264 - protein, 88 aa, Zea mays
  misc_feature: Ceres CLONE 1590564
  misc_feature (19)..(85): Pfam Name: LSM Pfam Description: LSM domain
MASTKVQRIMTQPINLIFRFLQSKARIQIWLFEQKDLRIEGRIIGFDEYMNLVLEDAEEINVKKNTPKTLGRILLKGDNITLMMNSGK

SEQ ID NO: 96265 - DNA, 627 bp, Zea mays
  misc_feature: Ceres CLONE 1590815
  misc_feature: Encodes the peptide sequence at SEQ ID NO. 96266
aagcgctaggcgccataccaaccatgagcgacctgttatcctacatttccaaggtcatgtgcatcaaggcaagatcggaggcaacacaagccggcgaggacggcggctgcccagcggacgagtgccgcgtctgcctgtccaagattcggctcggcgaggctacccgccgactgccgtgtcgccatgtgttccaccgggactgcgtcgaccggtggctctcgtcctgcaagcgaacctgtccgctgtgccgagtttatgtggccgatgggaacaagcagccggtggcggcaaagcacaccagccgtgaagcacaggcactcgccgacgacctggttatctggttctccaccgtgcttgttcccggtttctgatgccaaattccttcgtccgttcgttcgtttgaaaaagcttgattggtgtgtattttttttattgcatgcatgatacatgtacgtacctacgttactgttaattgtccttagaacagtttctagaaaatctgtgtgtatgtagcatcttgttgcatgaactgattggaacttctgtgtttgcagctgattactgaaaataagaagttcgagcaaatatatgttatcgaaatttatggtactaaaaaaaaaaaaaaaa

SEQ ID NO: 96266 - protein, 115 aa, Zea mays
  misc_feature: Ceres CLONE 1590815
  misc_feature (34)..(75): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MSDLLSYISKVMCIKARSEATQAGEDGGCPADECRVCLSKIRLGEATRRLPCRHVFHRDCVDRWLSSCKRTCPLCRVYVADGNKQPVAAKHTSREAQALADDLVIWFSTVLVPGF

SEQ ID NO: 96267 - DNA, 665 bp, Zea mays
  misc_feature: Ceres CLONE 1590956
  misc_feature: Encodes the peptide sequence at SEQ ID NO. 96268
ccgttccttccgtccatccatccgccatggcgaccgctacgctactgagctcctccttcgccatgcccgccgccgcccgtagggcctcctccccttcctccgcctcattgagcttcgccacgtcgcagctcgccggcctctccctctccgccggcgttgcaactccaaccgccgtcgccctcctccccaagaggcagcagctccagcccattgtcgcgcggcgtgtgtgcccgttcacggacaagaagacgaaccgggcgaacaaggtgtcgttttccaaccacaagacgaagaagcagcagttcgtgaacctgcagtacaagaagctgtggtgggaggccggcaagcgcttcgtcaagctgcgcctttccaccaaggccctcaagaccatcgagaagcacggcctcgacgccgtcgcgcgcaaggccggcatcgacctcaacaagaagtgagcaagaagtgagcccatccgatgagcagccaaactagtgtggggtggcactagcttagcattcacgttcgcagggtcgtctcgtctgtctgtctgcctgcctgcctcctgctgttctttcgcaatcaaaccatatcattatatttccctccccgttttgatttgtgtaccataccaatcagtgtaggcagatcgaggttgcacaaaaaaaaaa

SEQ ID NO: 96268 - protein, 141 aa, Zea mays
  misc_feature: Ceres CLONE 1590956
  misc_feature (66)..(126): Pfam Name: Ribosomal_L28 Pfam Description: Ribosomal L28 family
MATATLLSSSFAMPAAARRASSPSSASLSFATSQLAGLSLSAGVATPTAVALLPKRQQLQPIVARRVCPFTDKKTNRANKVSFSNHKTKKQQFVNLQYKKLWWEAGKRFVKLRLSTKALKTIEKHGLDAVARKAGIDLNKK

SEQ ID NO: 96269 - DNA, 662 bp, Zea mays
  misc_feature: Ceres CLONE 1591231
  misc_feature: Encodes the peptide sequence at SEQ ID NO. 96270
ccaccagtccgctcaatcatcgccatctcttctcttcttttgctcgctctatacatataccagagaggtaggtagctagctagctagtggtgaaaatacaatggcgcagcggcagggaagaggcagtggtgctgtggcccttgcggcggcggcggcggtgctcctctgcgtgctccttcatgcccacgtcgcggagtcggccgtgttcaccgtcggcgaccgtggcggctggagcttcagcaccggcacctggactaatggcaagcgcttcaaagctggggacgtcctagtgttcaagtacgactcgacggcgcacaacgtggtggcggtgaacgcggccggctacaaaggctgctcggcgccgcggggtgccaaggtgtacacgtccggcaacgaccgcgtcacgctggcccgcggcaccaactacttcatctgcagcatccccggccactgccagtccggcatgaagatcgccgtcaccgccgcctgagtcctgaccgatcgcggctgccgccggcacgcctgctgccgcgggctacatacatctacctatcgactgcctgattgtcagtttgactggcttgtatcgactccctgattgttatatatatatgaataaaacacaccatcatgattcgatgcgttaaaaaaaaaaaaaaaaa

SEQ ID NO: 96270 - protein, 129 aa, Zea mays
  misc_feature: Ceres CLONE 1591231
  misc_feature (44)..(122): Pfam Name: Cu_bind_like Pfam Description: Plastocyanin-like domain
MAQRQGRGSGAVALAAAAAVLLCVLLHAHVAESAVFTVGDRGGWSFSTGTWTNGKRFKAGDVLVFKYDSTAHNVVAVNAAGYKGCSAPRGAKVYTSGNDRVTLARGTNYFICSIPGHCQSGMKIAVTAA

SEQ ID NO: 96271 - DNA, 2501 bp, Zea mays
  misc_feature: Ceres CLONE 1592634
  misc_feature: Encodes the peptide sequence at SEQ ID NO. 96272
gttccccgccgcccctcgcctccgctgcacgcgatcgacgatccacagccaccacctctgcgttccccaccggagcatcttcaccaatcaccactgggctggctcccgcgttccccactggatttctgcacccagcgcttcttctgaaatttagaaggcggtggaaccgtcaaatcaaatggagggatcctcttacgcgtcaaggagctacagcgaactagctgccgcagcttccggaggtggaaggacgctgagggtaataccgctgcggcatccgctgggttctctgtcgacgtcttccacgtcgccgtggtggcgggcggtggtgggaagggctcggggcatggggccgcttgattgggcggaggcggccttgccgtgtgtggcgtggacacggaactacagatggaagcaggacctccaggccgacctcgcctcgggcatcaccgttggagtcatgcttgtgccccaggcaatgtcatatgcaaagctggctgggctgcacccaatttatgggctctacacaggctttgtcccgttatttatatatgcaatatttggctcgtcacgacaactagcagtaggtccagtggcacttgtttctcttcttgtatccaatgttcttgggggtatagttaattcatctagtaagctgtacacagaattagccatattactggcattcatggttgggatattggagtgcttgatgggactgctaaggcttggttggctcattcgtttcattagccattctgtaatatctgggttcactacagcttcagccattgttattggtttatcccagataaagtatttcttaggttacaacgtcacaagaagcagcaaaattataccactaattgagagcataattgcaggagctgatgagttctcctggcctccgtttgtgatgggatcaatttttcttgcgattcttctaattatgaaaaatacaggaaaatccaataaaagattgcattttctaagagtttctggtcctcttacggctgttgtgcttggaacaatttttgtgaaaatctttcatccaccagccatatcagtggttggtgaaataccacagggtcttcccaggttctccattcctcagggatttgagcatctaatgtcacttgtgccaactgctgtactaatcactggtgttgctattttggaatctgttggtattgctaaagctttggcagcgaagaatgggtatgagttggactctaacaaagagttatttggtctgggaatagcaaatatctgtggttcattcttctctgcatatcctgccacaggctccttttctaggtcagcagtgaatcatgaaagtggggcaaaaactgggttatctggaatcataatgggcataatcattggtggtgctctcttatttatgaccccattatttactgatataccccagtgtgcattggctgcaattgtgatttctgctgttactggcctggtagattatgaagaggccatcttcttgtgggctattgataagaaagatttctttttatgggcaatcacatttatcacaacattagtttttggcattgagattggcgtccttgttggggttgcattctcattggcctttgtgattcatgagtcagcaaatccacatatagctgtcttgggccgtttacctggcactactgtgtacaggaatacattgcagtaccctgaggcttatacgtataatgggatagtagtggttggaattgatgcaccgatctactttgccaacattagctacatcaaagacaggttgcgtgagtatgagctcaatcttccaagttcaaacaagggacttgatgttggaagggtgtattttgtgatcctcgagatgtcccctgttacatatattgattcgagtgctgttcaagctcttaaagacttgcaccaagaatacaaagcacgccatattcagattgccatagctaacccgaaccggcaagtgtaccttctgttgtcaagatcgggcatcattgacttggtaggagctgggtggtgctttgtgcgagtgcatgacgccgtgcaagtgtgcctacagcacgtgcagaattcatcttcaaatgcgttgaagctacccgtgcaggcatcaggcgtgttgaccgattctgtttcgactcctaaaccagagcagcagcatcaaaagcagcacggcctcttcaaggacctatggaaggcacaggacagtaacgcggatgctggtggtgaggtgcagccactgctccggcaaaaccttgtgtaatactcctacaaaatacggagtacttcctgggatggactcacgccctcgctggcctatacatatacgtgtttatttatttgtctatgttgttgttaacatggtatcgtggtgaacaaaagaaactgaacatgccattgttactgtggtgtggcgttttttgtacacttttgatacctaaatggaactcctatgatttgggtctggaaaaaaaacaaaagaaaaaaaaaaaaaaaaa

SEQ ID NO: 96272 - protein, 695 aa, Zea mays
  misc_feature: Ceres CLONE 1592634
  misc_feature (178)..(482): Pfam Name: Sulfate_transp Pfam Description: Sulfate transporter family
  misc_feature (505)..(623): Pfam Name: STAS Pfam Description: STAS domain
MEGSSYASRSYSELAAAASGGGRTLRVIPLRHPLGSLSTSSTSPWWRAVVGRARGMGPLDWAEAALPCVAWTRNYRWKQDLQADLASGITVGVMLVPQAMSYAKLAGLHPIYGLYTGFVPLFIYAIFGSSRQLAVGPVALVSLLVSNVLGGIVNSSSKLYTELAILLAFMVGILECLMGLLRLGWLIRFISHSVISGFTTASAIVIGLSQIKYFLGYNVTRSSKIIPLIESIIAGADEFSWPPFVMGSIFLAILLIMKNTGKSNKRLHFLRVSGPLTAVVLGTIFVKIFHPPAISVVGEIPQGLPRFSIPQGFEHLMSLVPTAVLITGVAILESVGIAKALAAKNGYELDSNKELFGLGIANICGSFFSAYPATGSFSRSAVNHESGAKTGLSGIIMGIIIGGALLFMTPLFTDIPQCALAAIVISAVTGLVDYEEAIFLWAIDKKDFFLWAITFITTLVFGIEIGVLVGVAFSLAFVIHESANPHIAVLGRLPGTTVYRNTLQYPEAYTYNGIVVVGIDAPIYFANISYIKDRLREYELNLPSSNKGLDVGRVYFVILEMSPVTYIDSSAVQALKDLHQEYKARHIQIAIANPNRQVYLLLSRSGIIDLVGAGWCFVRVHDAVQVCLQHVQNSSSNALKLPVQASGVLTDSVSTPKPEQQHQKQHGLFKDLWKAQDSNADAGGEVQPLLRQNLV

SEQ ID NO: 96273 - DNA, 1836 bp, Zea mays
  misc_feature: Ceres CLONE 1592907
  misc_feature: Encodes the peptide sequence at SEQ ID NO. 96274
aattcttctccgtcctggacaccacacacacagcttccctctcttccattagccatccagtcaacaagtcgtgcgcagcgcagtggcaagagctagctaggagattgatccggcctagttctgttcagcatgaggaaggtgtgcgccaacccagacagagaggtcggcctcgacacagtgctcgaggtgcccgtcccggaccagctccaccacgatccgtcgtcgtcgtcgtcgggccacggccggcgccggcgacgcacgctcaaggcgtgggtgcggtcgcgcatggaccagcgccaccggcggcacagctcgccgccttcccaggcggacgtgcagctcatgctcggggtggtcggcgcgccgctggtgccgcagccagtgcaggcgaggaaggccatggtggccggagaggacatcaaggaagagccccttgaggtgtccaaggcgaagtacatcgtggagcagtacgtcgcggcgtctgggggcgagcgggcgctgagcgcggcgacgagcatgtacgcggtggggaaggtgctgatgaggacgaggtcgtcgtcgtcgacgaccaagcaggggcagagagcctgcaggacgggaatggtgggcgtggtccacggcggcgccgagatcgccggcggcctcgtgctgtggcagaaggggccggaggtgtggtgcgtggagatggtggtggccggcggcaccaagatgagcgccgggagcgacggcagagtcgcctggcgccagacaccctggcagcaggcccacgcttcgcgggggcccccgagacctctccgtcgatgcgtccagggtcttaacccgagatcaacggcgaacctgttctcgacagccacgtgggtcggcgagaagagcgtcgacggcgacgactgcttcgtgctccgcgtcgacgccgacccgctggccctgcgcgcccggagcggcggcgacgtcgaggtcgtcaggcacgccgtgtgggggtacttcagccagaggacggggctgctgtcccgcctcgaggacagccacctgctgcgcgtccgcgcgacgaagggctcgccgccggccgagacgaccacgtactgggagacctccatggactcgtccatcggcgactaccgcgccgtggacggcatcaacgtcgcgcacgccggccgcaccgtcgtctcgctgtcccggttcggcggcagcaccaacgacgacggcgctggatccgaatcggccggcgtgctcggcaggaggacgtgcacgtgcatggaggagaattggagcatcgaggaggtcgacttcaacgtcgtgggcctgtccgcggagtgcttcttgcctcctagagacatggtagtagtaccttgcagtcctaaaccagtcgtcgatgagaaggggcagtgtggccgccttgaccacagctgcaagaaagacgacgctcctgctgcacttgacgtcaggaacaagaacggtaatggcggtgccggtggtgtccatcgtcctgcgacggcaagaaaggctcttgtaacggcggcgacagggctaccctggtccgggactgccaaggttgtggctgtcgaaaccttcgacaccaccgccgagtaattagtattattactttgtatatgctgcgtagttacggaggcgtgcgcgtgttttgcgcgccccgtacgtgacgtctggtagctggcaagaacagtacctgtagtttcattttgctctgcatagtgcacagtacgagatatgcgtagaacccatgaacctttttctcctctggagttctactgttttccataacctgcaagaatacatatgctgtacggtaagaattaatgtcaaaaaaaaaaaaaaaaa

SEQ ID NO: 96274 - protein, 485 aa, Zea mays
  misc_feature: Ceres CLONE 1592907
  misc_feature (130)..(406): Pfam Name: DUF620 Pfam Description: Protein of unknown function (DUF620)
MRKVCANPDREVGLDTVLEVPVPDQLHHDPSSSSSGHGRRRRRTLKAWVRSRMDQRHRRHSSPPSQADVQLMLGVVGAPLVPQPVQARKAMVAGEDIKEEPLEVSKAKYIVEQYVAASGGERALSAATSMYAVGKVLMRTRSSSSTTKQGQRACRTGMVGVVHGGAEIAGGLVLWQKGPEVWCVEMVVAGGTKMSAGSDGRVAWRQTPWQQAHASRGPPRPLRRCVQGLNPRSTANLFSTATWVGEKSVDGDDCFVLRVDADPLALRARSGGDVEVVRHAVWGYFSQRTGLLSRLEDSHLLRVRATKGSPPAETTTYWETSMDSSIGDYRAVDGINVAHAGRTVVSLSRFGGSTNDDGAGSESAGVLGRRTCTCMEENWSIEEVDFNVVGLSAECFLPPRDMVVVPCSPKPVVDEKGQCGRLDHSCKKDDAPAALDVRNKNGNGGAGGVHRPATARKALVTAATGLPWSGTAKVVAVETFDTTAE

SEQ ID NO: 96275 - DNA, 1940 bp, Zea mays
  misc_feature: Ceres CLONE 1593330
  misc_feature: Encodes the peptide sequence at SEQ ID NO. 96276
agtcccgcgggccatggcatcctcatcctcatctcctctcacccgtgctcaccgcgcctccacctccacctcttccgtcgccgccgccctcctcgcttctgcctcgcccattcccccgcgccgcttcatccagctccacgcgcaccttcttcgcacgggccttctaatcttttcccccgtcacaaccacctccgccttcctctccctcgcggccgtctccctcccgtcccaccgcgcgctcgccgtcctcgaccaccacctcaccaccccgcactatctcccctccactttccagtgcaattccatcctccgcgccctctccgatccctccgacgcgctccgcttcctctgccgcgtgcgtgctctcggccgtcgcgggaacgccttcaccctggccatcctcctcaagccccgctgctcactcgcgcacgcgcgccagctccacgcaaacgttgtggcggagggtcacctccgcgacgccctcctcgccacctcgctgatgaggtgctatgctaaccgtggcgacggggacggcgcgcgcaagctgtttgacgaaatgccagtgagggacgcggtcgcatggaacgttctgatcacctgttatgcgaggaaccggcggacaaaggacgccctgaagctttttgaggagatgagaggcaaggacagtgagtcggagccagatgatgtcacctgcattctgctcctccaagcatgctcgagcctgggcgcacttgattttggtgagcaggtgtgggcgtatgccgaggagcacggttatgggggcgagctgaaggtgcgcaattcattgattacgatgtacttgaggtgcgggtgtgtggataaggcatacagggttttctctggcactcctcagaagagtgtggtcacatggaccgcaatgatctcaggattggcagcaaatggctttgggaatgatgctatctcagtatttgaagagatgattagatcagatgttgctcctgatgaacagacttttactggtgttctttctgcatgtagtcatagtgggctggttgacgagggttttaggttttttgatatgatgcgatgtgagtacggattgaagccaaacgttcgccactatggatgcattgttgacctaatgggccgggctggcttgcttgatgaggcttacgagttcgtgacaaatgagatgaaggttgcaccagatgcgacaatttggcgaactcttcttggtgcttgccgaatacatggtcatgttgatctcggggagcgtgtaatcggtaatctaattgaactgaaggcgcagcaagctggggactatgttctattgctgaacacttatgcagcagttggggaatggagcaaggtatctgaaatcaggaagttgatgcaggaagaaggaatacaaactactcccggctgcaccactgtggagcataatggtacagttcatgagtttattgcagatgatgatgcacacccaaggaaagtggagatttatgaaaatctcagtgagatatataagcagttaaggattgctggttatgttccaaatgtgtcatcagagttgcatgatttggattcagaagggaaggaaagtgccctcacctatcacagtgaaaagctggcaattgcttttgctttgcttgtgacgcctcaacacagaccaataaggcttgcaaagaatcttcgtgtttgtgttgactgccacaatttcacaaagatgttttctgctatttacagacgaatagttattgtcagggacagaacaaggttccatcatttccagggagggaaatgttcgtgtaatgattattggtagtccacccttgcttgttgcagttgcagcacaccacaagtgtagccaactaaggagatgtttggtttctagggactaaaaaaaaaaaaaaaaaaaaaaaaaaaaaaaaaaaaaaaaaaataaaaaaaaaaaaaaa

SEQ ID NO: 96276 - protein, 597 aa, Zea mays
  misc_feature: Ceres CLONE 1593330
  misc_feature (291)..(325): Pfam Name: PPR Pfam Description: PPR repeat
  misc_feature (188)..(222): Pfam Name: PPR Pfam Description: PPR repeat
MASSSSSPLTRAHRASTSTSSVAAALLASASPIPPRRFIQLHAHLLRTGLLIFSPVTTTSAFLSLAAVSLPSHRALAVLDHHLTTPHYLPSTFQCNSILRALSDPSDALRFLCRVRALGRRGNAFTLAILLKPRCSLAHARQLHANVVAEGHLRDALLATSLMRCYANRGDGDGARKLFDEMPVRDAVAWNVLITCYARNRRTKDALKLFEEMRGKDSESEPDDVTCILLLQACSSLGALDFGEQVWAYAEEHGYGGELKVRNSLITMYLRCGCVDKAYRVFSGTPQKSVVTWTAMISGLAANGFGNDAISVFEEMIRSDVAPDEQTFTGVLSACSHSGLVDEGFRFFDMMRCEYGLKPNVRHYGCIVDLMGRAGLLDEAYEFVTNEMKVAPDATIWRTLLGACRIHGHVDLGERVIGNLIELKAQQAGDYVLLLNTYAAVGEWSKVSEIRKLMQEEGIQTTPGCTTVEHNGTVHEFIADDDAHPRKVEIYENLSEIYKQLRIAGYVPNVSSELHDLDSEGKESALTYHSEKLAIAFALLVTPQHRPIRLAKNLRVCVDCHNFTKMFSAIYRRIVIVRDRTRFHHFQGGKCSCNDYW

SEQ ID NO: 96277 - DNA, 2642 bp, Zea mays
  misc_feature: Ceres CLONE 1593579
  misc_feature: Encodes the peptide sequence at SEQ ID NO. 96278
atccccatcccccccgcaatctccctctactagtgctgctgctctcattcctccaacaatccaaggttcgagctcattcattacacgaatctgcggccgtgtgggtgccggagagcggcgagcaatggagggggtgtggaggaaggccaagagggcgctgggcgccagcctctgtgtgcacctccccgccgtcgccggcgaccgcgaggacggcgccagcgagcgccgcgcctcggatgcgctctccctcgactctacagcggcggcgcacgcatcggcgcccaacacgccggccgcgccggggaccggcgcgctgcggaggtccaagtccggaggcaaatcctccaagagaatgtgtgcaatatgttttgattccatgaagccaggtcttggacaagccctattcactgctgaatgttctcatatgtttcacttccactgcatctcctctagtgtgaaacatggaaaccatgtatgcccagtatgccgggcaaaatggaaagagatccccttcaatcgctcattatcttctatagttcctcgtggaagaggtggactgaatgtaaaccaagctcgattgccccaacaaggtgcctacatggctcttctccgccaggttccaaaccgtcagcgagaaggtccagtattggttacttctgagccatcagacttcaatgatgatgaacctttgcataagatggagcctgctaatattggatctagtagaactgtggaaattaagacatattcagagttttcagccattcaacagtcatctcaagatgactttgctgttctgatccatctgaaagccccatatgctaacccagagcaggtcataggcagaccggtcaatgcaacctcagttggttatcctactgcccgcgccccagttgatcttgttaccgtgcttgatgttagtggaagtatggcaggcactaaactggcactcttgaagcgagccatgggttttgttatacagcatcttggcccatcggatcgcctttcagtcatcgctttctcttcaaccgccagaaggttgttccatctccaacggatgtcacactctggccggcagcaggccctgcagactgtcaactcacttgttgctagtggtggcacaaacattgctgatgcactgaagaaagctgctaaggttattgaggaccgaagccatcaaaatccagtatgcagcatcattctcttgtctgatggccaagatacgtacaatattccctcaaatattaggggtgcccggccagaatacagttcactagttccatcctccattctaaaccgcacatttggcttagtgccggtgcatgggtttggttttggagtagaccatgattcggatgctttgcattcgattgcggaggcctctggcggtacattctcctttatcgaggatgaaggtgtgattcaggacgcatttgctcagtgcataggtgggctcctcagcgttgttgttcaaaacatgcaagtaaatgtggagtgtgtccatcctggtgtccagcttcgctccatcaaatctggtagttaccccagcaaggtggctgcacatgggcgaaatggttccattgaggttggccatctctacgccgacgaggaaagggacttcctactgtcggtgagcttaccacattgtcgtgaacagaccacacttctgaaagttgcctgtgcctacagagattcattgaccaacgaagagatcaagattcagggtggcgaggtagcaatcttgaggcctagatcacccgtatctgagccagtttgcatggaggttgaccgcgagaggaaccgtgtccgtgctgcggatgctatcgaggccgcaagggctgctgctgagagaggtgctctttctgatgccgtgtcaatccttgaagactgccggaggatactttcagaaactttttcaagcaggagcggggaccggctgtgcatggcccttgatgcagagctgagggagatgcaagagaggatggctaaccggcaacgctacgaggcttcagggagggcatacctgctgtctggcctcagctcacattcttggcagagggccactgcgcgaggcgactccactgacagtgacacacttgtttattcctaccagacaccatccatggttcacatgctacagcgctcacagaaccactgcccttctcctcaaggcccttcacaacctagggtcttggtgaaaccccagccaaggtagaaggcaactgagcaattcagcattatcttgcgaagcgagggcacagatgtcggtgaagaaattcaattcgtatggctgcgtattaggtcatagtgtagttctccagcacctttattttgttgtctaaagtcgtggtggtgggtgggtgggtataccagaggcggtgaggcgggcttggaggtaaatataatctggttgggtatactggggaacctaaggtgggggctttggtggtaaatacattgtggggggtatactcctgtggtgttaagaaataagtaggctagtagttagtagaggaggggctggagaaattgtgtaatagtttcaactggttggagctaggtagtttagtggaggtcagttcttggcaatgtctttatttgatctttggtgaagtagataagagggtctgatctcggggggg

SEQ ID NO: 96278 - protein, 696 aa, Zea mays
  misc_feature: Ceres CLONE 1593579
  misc_feature (258)..(440): Pfam Name: VWA Pfam Description: von Willebrand factor type A domain
  misc_feature (78)..(121): Pfam Name: zf-C3HC4 Pfam Description: Zinc finger, C3HC4 type (RING finger)
MEGVWRKAKRALGASLCVHLPAVAGDREDGASERRASDALSLDSTAAAHASAPNTPAAPGTGALRRSKSGGKSSKRMCAICFDSMKPGLGQALFTAECSHMFHFHCISSSVKHGNHVCPVCRAKWKEIPFNRSLSSIVPRGRGGLNVNQARLPQQGAYMALLRQVPNRQREGPVLVTSEPSDFNDDEPLHKMEPANIGSSRTVEIKTYSEFSAIQQSSQDDFAVLIHLKAPYANPEQVIGRPVNATSVGYPTARAPVDLVTVLDVSGSMAGTKLALLKRAMGFVIQHLGPSDRLSVIAFSSTARRLFHLQRMSHSGRQQALQTVNSLVASGGTNIADALKKAAKVIEDRSHQNPVCSIILLSDGQDTYNIPSNIRGARPEYSSLVPSSILNRTFGLVPVHGFGFGVDHDSDALHSIAEASGGTFSFIEDEGVIQDAFAQCIGGLLSVVVQNMQVNVECVHPGVQLRSIKSGSYPSKVAAHGRNGSIEVGHLYADEERDFLLSVSLPHCREQTTLLKVACAYRDSLTNEEIKIQGGEVAILRPRSPVSEPVCMEVDRERNRVRAADAIEAARAAAERGALSDAVSILEDCRRILSETFSSRSGDRLCMALDAELREMQERMANRQRYEASGRAYLLSGLSSHSWQRATARGDSTDSDTLVYSYQTPSMVHMLQRSQNHCPSPQGPSQPRVLVKPQPR

SEQ ID NO: 96279 - DNA, 2180 bp, Zea mays
  misc_feature: Ceres CLONE 1593751
  misc_feature: Encodes the peptide sequence at SEQ ID NO. 96280
ctagtgtttatttgctctagtccctatcacctttaattgtgaattgtgatgctagctttatctagttttttttttccagtttctgtttccctctgctatttacatgattgtgtttgaaagtttcagagttttctgttttagcatcgtatgcttgattttcgcaaattgatgcttaatcatcgatttccatctatttggtatgatatggttttcattatctttacttctttgggtaactagctttcccaaattgaagtctcaactttgaaacgttggagttagacctgatctttgtgttaaatatgatgcagggaaggttcataatatgatggccgcagagttagtaaagcagtattcaaacatcactctgggagaagataataagatatgtgatattaaacaagcgcttaaggccttgagaaagaagattcttagtttggattttgacaactccatgcacgtccatgacccacaggactcatttgagtacttggaagtgctgcgcaaaatcaaacaactatctgaaaagttaaggaccttagaccctggtggggaagccaaacaactggatgaactcactgtgtatgcatatgaaatttctgaaatggcaatggcaagacttgaagaggaatttatttatctccttacacatttcaaacaaccattagaacaggaggttctctcttttcgctctacagaggatggtagtgtggaagacttttcaagcagttcatttagtgaggaaccatcggatgggaaggcaacaccgaatgatatcagtggaggaccagaatattttgtgcctgatttaattcaacccggtgcactctctgctgtcaagtccattgctaaattcatgttcctgaatggctatgataaggagtgtttacaggcttatataaactcacggcagactgcaatagatgagtactttgggtctcttcgtctggaaaaactcagtatagaggagcttatgaacacaagctggaataagttgaattcattaataaagagatggaaccgggcaatgcgtggttttattcgagtatatcttgtaagtgagaaacggcttagcaaccatgtctttagtgaacttacagattcaactgctgacttgtgcttctctgagatttcattcaactcagttgtacaacttctgagcttttatgtatctgtagcaattggaccccccaaaacagaaaagctttttcgattgcttgatatgtatgaggtcctggatgatcttctccctgaagttgaatccttgtttgaaccaaagtacggtgatatgatcctgaatgagtatcatgaagcactactgcaactgggagaatctgcaaggaagacatttgcagaattcaagtgtgccatccaatcatacacttcatccaatgcagtagctcgtggagaagtgcatccacttacaaagtatgttatgaactacataaaggctctcactgcatacagcaaacctcttgattcacttctcaaggacacggatcgaagatgcctgacttctgatattcagttgatggcaaatacatatcctaatttcacggcaacagctttgcatctacagtctgttactgcagttttggaggcaaatcttgaagctgggtctagattgtaccgagatgatcgactgcagaacatcttcatgttgaacaacacccactacatggttcagaaagtgaagaactcggatctcaaaagctttcttggtgatgactggatccggattcataacaggaaatttcagcagcaagctatgagatatgagagggcatcatggaataatgttctctcttacctcagtgatgatggcttgtgtgcttctggtgatgctgcttctcgcaaaaccatcagggagaagataaaaaatttcaatctgtcctttgaagaggtttaccgagttcagacagcatggtctgtcccagatgaccaacttcgcgacgacgtccggatttcaatatcactgaaagttatacaggcctataggaccttcgtgggaagatattcaggctttcttgatggctcaaggcatcgagatcgttatgtaaagtacagggcggaggatctggagacacttttgctagacctttttgaaggaactcaaaagacactgcagcattcttgtcgagtgtaagattaaaccagttcttgaagaagagatgcctcag

SEQ ID NO: 96280 - protein, 606 aa, Zea mays
  misc_feature: Ceres CLONE 1593751
  misc_feature (9)..(594): Pfam Name: Exo70 Pfam Description: Exo70 exocyst complex subunit
MMAAELVKQYSNITLGEDNKICDIKQALKALRKKILSLDFDNSMHVHDPQDSFEYLEVLRKIKQLSEKLRTLDPGGEAKQLDELTVYAYEISEMAMARLEEEFIYLLTHFKQPLEQEVLSFRSTEDGSVEDFSSSSFSEEPSDGKATPNDISGGPEYFVPDLIQPGALSAVKSIAKFMFLNGYDKECLQAYINSRQTAIDEYFGSLRLEKLSIEELMNTSWNKLNSLIKRWNRAMRGFIRVYLVSEKRLSNHVFSELTDSTADLCFSEISFNSVVQLLSFYVSVAIGPPKTEKLFRLLDMYEVLDDLLPEVESLFEPKYGDMILNEYHEALLQLGESARKTFAEFKCAIQSYTSSNAVARGEVHPLTKYVMNYIKALTAYSKPLDSLLKDTDRRCLTSDIQLMANTYPNFTATALHLQSVTAVLEANLEAGSRLYRDDRLQNIFMLNNTHYMVQKVKNSDLKSFLGDDWIRIHNRKFQQQAMRYERASWNNVLSYLSDDGLCASGDAASRKTIREKIKNFNLSFEEVYRVQTAWSVPDDQLRDDVRISISLKVIQAYRTFVGRYSGFLDGSRHRDRYVKYRAEDLETLLLDLFEGTQKTLQHSCRV

SEQ ID NO: 96281 - DNA, 2025 bp, Zea mays
  misc_feature: Ceres CLONE 1593944
  misc_feature: Encodes the peptide sequence at SEQ ID NO. 96282
aaaaaaaaacatcctcgccgcccgtcggcttgcattgcagttgcagcagcgcacaattaattggaagcgatcttctttcccgggtcatcaagtcctctcctcatcggccaaccatcacacagcacctccgcgagggatcccgcctctgcctggccgccgcccgtcgcctttgcagcaaggaagaagcgatcttctctcccgacaagtcctcgccggatctaagctagcgtgtggcttggcagtaccggggttttcaataaggactaaacacgttagggaataatgcttccagaaagatgtgcttgtatgttgaagagctatcctgcgagggactcggcagagtagcatgccatactcatcatcatgcatatatcatttgctagatcttgatgaccttgaagctcaagagtatctttcacacgatggcttcttggatcaccatcttgggggagacgattgaagtcttgcattggtcctctttttcttgtcaaggataagcaagtacccgcgcgctatctgtgtgcacacacacgggcatgcatgcatgcaagatgatggcgggacataataaaagaaacattattctcatgcacaagtatgagatggggagattgcttggtcaagggaccttcgctaaggtctaccatgctcgcaacaccaggacctcagtaagtgtcgcgatcaaggtgatcgacaaggggaaggttgtgaaagtcggcctcgtcgaccagatcaagcgagagatttctgcgatgaagctcgtcaggcacccaaacgtcgtgcagcttaacgaggtcatagccaccaagaccaaaatatacttcgtgttggagtatgttaaaggcggggagctcttggctaaagtaaagcgaggaaggcttaaggaagatgtggcgaggaagtacttccaacagttgatctgtgcgctggacttctgccatagcaggggtgtctaccatcgggacttgaagctagaaaaccttttgctcgatgagaatagcgacctcaaggtatcggattttggtctaagcgcgcttgctgaatgccgaaggcaggatggcctgctccacacgacctgcggcacgccggcctatgttgctccggaggtgattaacagaaagggttacgatggtgcaaaagcagacatatggtcatgcggggtcatcctctttgtgctattggctggttatcttcctttctatgataagaacttgattgacttgtataagaagattgacagtgcagatttcagatgcccgacctggttttctactcatgttcggaggcttttgctaaggattcttgatcctactcctggtacaaggatctcaatagaaaaaatcatggagaatccctggtttaggcagggcttagatcatgcaaacctactacttagatataatttaaagactaatgatgcccctcaagtggacacggacaagaatgaagattttgatccaccgagcaccaacataacaacagatagcaagcaagaagacgaaaagaagcctgccaacatgaatgcatttgatataatatctcatctatcaagtggtttggatctctcaggtttattccaagaatctgacaagaaaacagaatctaaattcacttctaccaacacaagctcggcaatcatatcaaagattgaggatattgccaaggatttgcgactgaagttgactaaaaaggatggtggtttgttaaagatggaagcttcaaagcctggaaggaaaggggtgatgcgtatcgatgctgagatatttgaagttagcccaaacttccatctcgtggagatcaaaaagactaatggtgacactctagagtatcaaaaggtcatgcaccaagaaatgaggcctgcacttaaggacatagtatgggcttggcaaggtgagcaattaaagcagcagcaggaacaacaacaatagtcgtgttaaaaactatgagatagtgtataacgttttttaggcagattccaatattacatgcatttgtgtagttctcactccaaaaaaaaaaaaaaaa

SEQ ID NO: 96282 - protein, 463 aa, Zea mays
  misc_feature: Ceres CLONE 1593944
  misc_feature (21)..(275): Pfam Name: Pkinase Pfam Description: Protein kinase domain
  misc_feature (324)..(384): Pfam Name: NAF Pfam Description: NAF domain
  misc_feature: SWISSPROT Homolog: EC 2.7.11.1 Non-specific serine/threonine protein kinase
MHACKMMAGHNKRNIILMHKYEMGRLLGQGTFAKVYHARNTRTSVSVAIKVIDKGKVVKVGLVDQIKREISAMKLVRHPNVVQLNEVIATKTKIYFVLEYVKGGELLAKVKRGRLKEDVARKYFQQLICALDFCHSRGVYHRDLKLENLLLDENSDLKVSDFGLSALAECRRQDGLLHTTCGTPAYVAPEVINRKGYDGAKADIWSCGVILFVLLAGYLPFYDKNLIDLYKKIDSADFRCPTWFSTHVRRLLLRILDPTPGTRISIEKIMENPWFRQGLDHANLLLRYNLKTNDAPQVDTDKNEDFDPPSTNITTDSKQEDEKKPANMNAFDIISHLSSGLDLSGLFQESDKKTESKFTSTNTSSAIISKIEDIAKDLRLKLTKKDGGLLKMEASKPGRKGVMRIDAEIFEVSPNFHLVEIKKTNGDTLEYQKVMHQEMRPALKDIVWAWQGEQLKQQQEQQQ

SEQ ID NO: 96283 - DNA, 1948 bp, Zea mays
  misc_feature: Ceres CLONE 1593972
  misc_feature: Encodes the peptide sequence at SEQ ID NO. 96284
aaattcaaacgaagacagactagctggagctggatccagccaggtaataatattactgctgctgctgagatgacatcaatctttcttgctgcagggaagagaatccaactccatgcaaagcgtgtcaacgagcttttaattctctcagcctccaggcatcatctataggacatatacttattccataggtgccttatgtatacaatatttcgagagcatatacaaaaaaacaaaaaaaaaatgaatctttttcgtatcttctctgcagattaattgaacagtaccagtgtttaatttctgtttaagtggccctctccaactaccgtgagaagcaaagctcagctcagggagttagctgatgcatcaagctctgccttttaacttgccatcacttttaatttcacttggcggcatagatttttatttatactccatataatacaccatgcatgggcatgggcttcttcacctctcggtcggtcggcccccttcctgtgccttgccttgctttccgcaggaggatgcggagctgcttcttctgagttctgatcgctgacagagcagctagcagccgacttctgatggacgcggccatggcgctcgccttgctcttcttctgcgtcctcctgctggcctccggcgccatcgccttcctcctcatccgccactgcctcgcgcgagcacctcctcatcgtcatcgtcaggcacagcccgaagcagcggccaagcagctgcagcagcaagcgttactagccatcaagaaggagccggcaccgcggcggctggcgtggcgggaggtggaggcgctgaccggcggcttcgacgaggccgccgtggtaggccgcggcggctccagcaccgtctacctcgccaggctcctggacggctcgcccgtcgccgtcaaggtgcaccgctggtgcggcggcgagcgccggctgcgcgccttccgccaggagctcgacctgctccgccgactccgacacccgcacatcgtcgcgctcctcgcctactccgacgaccacgaggatgagggcgcgctggtgctggagtacctcggcggcggcacgctggcggacgcgctccacggcacggcggcggccccgctgccgtgggcgcagcgcatgcgcgtcctccacgacgtggcgtgcgcgctggagcacctgcacggcggcggggcctccgtggtgcacggcgacgtgtcggcgtccaacgtgctcctctccgacggcggcgcgcggctctgcgacctgggctccgcctgcgagggcttctcggcggccgtggcgccggcgcgcgccgccgtggcgtcgccgggctacgccgaccctttcttcctgcgcacgggcatcgtgtccagcaggtccgacgtgtacggcttcggcgtgctgctgctggaggccgtcacgggcctgccggcggcgtccgaggccgagaacctgacggcgcggatcctgccacgcgtcagggcgcgcggggtggcggggctcgtcgacggcaggctcggggacggcgggcacgacgaggaggaggccgccggcgtggccaggctcgccgtggagtgcgtggcggcgcagcccgggctgcggccgtcgatggcgcaggtgcgcgccgccatcgcggagaaggcggcgaggtccatcgccaaggcgggttgcggccaccatatccagctcagcaagctgctagagctcacatgatttttatttcctccatcgagaatttaggattgtgaaaaatggatcgtgcattgcagaggaaggaggacttgatattgaccatttaaagaaaagatgattgagtgcaggggagcaagagaagcattgctcatcattcaggtggttggttgtggtcggaagcagcggcagtttttggaggacttaatatacacttgggattttgccgcaaaaaaaaaaaaaaaaaaaaaaaaaaaaaagaaaaaaaaaaaaaa

SEQ ID NO: 96284 - protein, 371 aa, Zea mays
  misc_feature: Ceres CLONE 1593972
  misc_feature (80)..(345): Pfam Name: Pkinase Pfam Description: Protein kinase domain
  misc_feature: SWISSPROT Homolog: EC 2.7.11.1 Non-specific serine/threonine protein kinase
MDAAMALALLFFCVLLLASGAIAFLLIRHCLARAPPHRHRQAQPEAAAKQLQQQALLAIKKEPAPRRLAWREVEALTGGFDEAAVVGRGGSSTVYLARLLDGSPVAVKVHRWCGGERRLRAFRQELDLLRRLRHPHIVALLAYSDDHEDEGALVLEYLGGGTLADALHGTAAAPLPWAQRMRVLHDVACALEHLHGGGASVVHGDVSASNVLLSDGGARLCDLGSACEGFSAAVAPARAAVASPGYADPFFLRTGIVSSRSDVYGFGVLLLEAVTGLPAASEAENLTARILPRVRARGVAGLVDGRLGDGGHDEEEAAGVARLAVECVAAQPGLRPSMAQVRAAIAEKAARSIAKAGCGHHIQLSKLLELT

SEQ ID NO: 96285 - DNA, 2136 bp, Zea mays
  misc_feature: Ceres CLONE 1596118
  misc_feature: Encodes the peptide sequence at SEQ ID NO. 96286
agtggcagaagctccacaagtccacaacaccttctgctcctgcctcgccggccgccgccgcgtcccggctagcccgaaggaactccgccgcaaatacagctatgagctcagccgcttccgcggcgccacctagccgccgcactaggagccgcccgccatcagcttcttctcgcaagtctgacgactcctcggccgccgccgccaacgggaatgggaacaggaaggtcgcaaccaagcccgcctccccccaccagctcacgggggagaggacagtgaagaagttacggctctccaaggcactgacgataccggaggggacgacggtgttggatgcgtgccggcggatggcggcgaggcgggtcgacgccgtgctgctcaccgacaaccaagggctcctctccggcatagtcaccgacaaggatatagctacaagggtggttgctgaggggcttagggtggagcaaaccatcatgtccaagatcatgacacgaaatcctgtttatgtgatgtctgacacgctcgccattgaggctttgcagaagatggttcaagggaaatttagacaccttcccgttgtagaaaatggtgaggttattgctatgctggacattgcaaaatgcctttatgaagcaatagcaagactggaaaaggctgcagaacaaggaagtgcaatagcagctgctgttgaaggggtcgaacgtcaattaggagggaacttttcagctccttctgctctcattgaaactctaagggagaggatgttcaaaccttctctgtcaaccatcgtcacagagaatacaaaagtagcaattgtttcgcctacagatcctgtgtgtgtagcagcacaaaaaatgcgagagttttgtgttaattcagtggttgtctctacaggaaacacattgcaggggatctttacctcaaaagatatacttatgcgtgttgtgtcacaaaatatttcccctgagttgactctagtagaaaaggtgatgactgttaacccagattgtgccacattagaaacaacaattcttgatacattacatataatgcatgatggcaaattcttgcatattcctgttattgacaaagatggacagattgctgcttgcctggatgtcctgcaacttacccatgcaactattcaattggttgaaggagggaatggaactgtgaataatgtcgcaaactcggtaatgcagaggttctgggactctgctcttgcattggagcctccagatgaggaatttgatagccatagcgaggtatccttactcctgcagtcagaggctggagatggaaagagtagtgtttatccccctgtggttggcaattcgttttcctttaagctccaagaccgaaaaggccgtgtgcacagatttacttgtggctcagagagcttggacgagcttgtgtcttctgtaagacaaagattaagtattgctgatgaaaaagaagctgtgcaactcttgtatgaagatgatgaaggtgaccgagtgctgctgacaacagatgccgatcttgctggtgcactgctgcatgccaaatcatctgggttgaaggtgctgaagttgcacatcgaagaccctagtttgaacactgaagtgacaaaaccatcccaagagctggcaccacctcccctcaagagtgggatatcgatggttcatgttgggttaacggccggtgtagtcgctctcagtggcgcagcagtgatggtttacttgaaacgatctcaactgtgatttcgaaaatcggaggatgttttttaggagcttgattatctgaaacaagcattgccatcagctaatgcattctgaagctttgccttcactcggtgccatttacaagctaagaactgaaggaatgtacagaaatgaagaccacatctgtgatcttttgatgagctgaaagtccgtacaggccacgggacaagatcactgtttttggaggtgaatttctgggcagaacggcgtgcctatctttgttcattcagcacaagccgtggcaatttcacgactatgatgtaatgtgtaaacattacatatttgttcctattcatactgatgtatttgtttgtagataaaaactcatttcacatgacactattgtttgagaaaaaaaaaaaaaaaaaaaaaaaaa

SEQ ID NO: 96286 - protein, 545 aa, Zea mays
  misc_feature: Ceres CLONE 1596118
  misc_feature (60)..(178): Pfam Name: CBS Pfam Description: CBS domain pair
  misc_feature (229)..(347): Pfam Name: CBS Pfam Description: CBS domain pair
  misc_feature (411)..(495): Pfam Name: PB1 Pfam Description: PB1 domain
  misc_feature: SWISSPROT Homolog: EC 1.1.1.205 IMP dehydrogenase
MSSAASAAPPSRRTRSRPPSASSRKSDDSSAAAANGNGNRKVATKPASPHQLTGERTVKKLRLSKALTIPEGTTVLDACRRMAARRVDAVLLTDNQGLLSGIVTDKDIATRVVAEGLRVEQTIMSKIMTRNPVYVMSDTLAIEALQKMVQGKFRHLPVVENGEVIAMLDIAKCLYEAIARLEKAAEQGSAIAAAVEGVERQLGGNFSAPSALIETLRERMFKPSLSTIVTENTKVAIVSPTDPVCVAAQKMREFCVNSVVVSTGNTLQGIFTSKDILMRVVSQNISPELTLVEKVMTVNPDCATLETTILDTLHIMHDGKFLHIPVIDKDGQIAACLDVLQLTHATIQLVEGGNGTVNNVANSVMQRFWDSALALEPPDEEFDSHSEVSLLLQSEAGDGKSSVYPPVVGNSFSFKLQDRKGRVHRFTCGSESLDELVSSVRQRLSIADEKEAVQLLYEDDEGDRVLLTTDADLAGALLHAKSSGLKVLKLHIEDPSLNTEVTKPSQELAPPPLKSGISMVHVGLTAGVVALSGAAVMVYLKRSQL

SEQ ID NO: 96287 - DNA, 2683 bp, Zea mays
  misc_feature: Ceres CLONE 1597058
  misc_feature: Encodes the peptide sequence at SEQ ID NO. 96288
aagagtctctacccgtgatttccattctaaaaattatccttcctcccgtgcctacagtcctacacctcgacgatgccaaaaccctagcgcagcagcgcgaactacacctctccccgtcctgttcctcgtggcgcggtagccatggcggagccggccatcctcgacccctcccccttcgatctccgccactatccggcgcacctcttcgacccggacatccccctcgccgccgccgacttcccactcggtgaattcgccggagacgacggctgtgatggcctagacttcgacgtgcccgtagatttctctatcgacgacttcctcctccggtctcctgaccgcgggcacgacggcgacgactccggcgagggctctgctgccggatccggccccaccgcatcttccttggcctccccggccacctccggcactaactccgccgtggccaacgtcggcaaccgcaaggtgaagcacgaggactcggacgagggaaggagcggcgccaccccgaattggagcctcaagcggaagcaggtgagtcccggagaagcaacctcggatggggccaagtgccgccgatccggcgatggggatgtttcgccatctgcatcggcgtcgcgtgcagccacggaggactccgatgagaggggcgtgggcggcgaggaagaggacaagcgccggactgcgcgcctgatgcggaaccgtgagagcgcgcagctctctcggcagaggaagaagcggtacgtggaggagctggaagagaaggtgaaatcgatgcactcggtgataaatgacctcagttgtaagatctccttcatcgctgcggagaacgccacactgaggcagcaactcggtggtgtgggggtgagtggaccaccacctggggtgtatccaccgccaccgccaggcattcatttcccttgggtttctgggtatgcaatgcggcctcatggctcccatgttccacttgttccaatcccgcgattgaagccgcagcatgcagcagctgcagtgaaggtatccaagaaaccagatgtcaagaagtctgtggagagcaagagtaagaccaagaccaagaccaagaccaagaaggtggcaagtattagccttcttggtttgctgtttgttgcatttgtctttggcgcttttgttccggggttcaatcatagtctcggactgagaggaaggagcgacaatgtgatgtttggaaattttggccagtctgatgctagggtgtttagtgtcactaaccatggtaaaggacctaaaggcagtttcaacagtagtgacatgatcagtactgatcatgacatgatgactgggcatgatgatggagcggggcagaaacaccgagctgcaaataactctagtgagatcttgcctgctttgttgtatgtgccgaggaatggaaaacatgttatgatcaatggcaatttgattattcattctgtgatggctagtgagaaagcagtggcacataagggctcaaatagtcagtcagttaaagatcacaaggagaccagtgttgctatagctcgctatctgtcaccacctggaaaggatatgaattcaaaagagatgttcccgccagatgcaccactgccacaatggttccgtgaaggaatggaaggacctgttttgaactcgggaatgtgcagtgaggtatttcagtttgatatttctccagcttcggccaaatctggtggcattatacctgcttcggccaaatctgcctcaagtgtcaatgctacccagaaaattctgaaaccttctcctgcttataggggcaagctgaaaaacaggaggatcatgtataacgaggcaattccacttactggaaaaacagcgaacaacacaaagcctcaggcttttaacagtactgctgaaagcagcaaggtacctgatactgatagcaagcctgcatcatcagttatcgtctctgtgctagctgatcccagggaggctggcaatggggatggtgatccaagagtatcaccaaaacccctctccaggatatttgtcgtcgttctgctcgatggtgtcagatacgtgacttactcgtgcacacttcctttcaagagtgccagcccacaccttgtgaactaaccttggggccggtgcagctttctggtccatgagcggctaaatagttggggttttctgatgcattggaggtagatgaatgaatacagtaatgtggtgttgcttgctaacaatgaaaacagacttcaagactcgcactcggcctgaggtaatttgagtttgtcgaaggtttgtagtgtggactggcgaaatgttgtgcaagttcaaccttaacccatgaggtttgtgcttctatgtagtcgagttattatactcacctctttctctggtactctttattgcggagctggaaaatataacagctgatgagagaagacaatatttggaaaataactttgtactagtatatattatatatatagtgtactatatatagggatgtaatatggttcggaaaatatccgtccggatccggattctaagatggtgaacactggttcggatggaattttcggatatgcggacttttttctggataacggatacgaatacagatattttgttcggatatcgaattcgaatacaatgtatcggatatcgaatattcggatattttctcgggcaaaaaaaaaaaaaaaaa

SEQ ID NO: 96288 - protein, 654 aa, Zea mays
  misc_feature: Ceres CLONE 1597058
  misc_feature (175)..(238): Pfam Name: bZIP_1 Pfam Description: bZIP transcription factor
MAEPAILDPSPFDLRHYPAHLFDPDIPLAAADFPLGEFAGDDGCDGLDFDVPVDFSIDDFLLRSPDRGHDGDDSGEGSAAGSGPTASSLASPATSGTNSAVANVGNRKVKHEDSDEGRSGATPNWSLKRKQVSPGEATSDGAKCRRSGDGDVSPSASASRAATEDSDERGVGGEEEDKRRTARLMRNRESAQLSRQRKKRYVEELEEKVKSMHSVINDLSCKISFIAAENATLRQQLGGVGVSGPPPGVYPPPPPGIHFPWVSGYAMRPHGSHVPLVPIPRLKPQHAAAAVKVSKKPDVKKSVESKSKTKTKTKTKKVASISLLGLLFVAFVFGAFVPGFNHSLGLRGRSDNVMFGNFGQSDARVFSVTNHGKGPKGSFNSSDMISTDHDMMTGHDDGAGQKHRAANNSSEILPALLYVPRNGKHVMINGNLIIHSVMASEKAVAHKGSNSQSVKDHKETSVAIARYLSPPGKDMNSKEMFPPDAPLPQWFREGMEGPVLNSGMCSEVFQFDISPASAKSGGIIPASAKSASSVNATQKILKPSPAYRGKLKNRRIMYNEAIPLTGKTANNTKPQAFNSTAESSKVPDTDSKPASSVIVSVLADPREAGNGDGDPRVSPKPLSRIFVVVLLDGVRYVTYSCTLPFKSASPHLVN

SEQ ID NO: 96289 - DNA, 1882 bp, Zea mays
  misc_feature: Ceres CLONE 1597178
  misc_feature: Encodes the peptide sequence at SEQ ID NO. 96290
aaagcccaccacgctgataagccaacaaagctagctgctccccattccccaatatggccgccgccgctgccgccaagcacgtggtgctcttcccgttccccggtcagggccacctctccgcgttcatgtctctcgccggcctcctacacagtgctctccccgacgccgctatcaccttcgtctccaccccgcgcaacgttgcttcgctccagacttccgcgtggtccaacgcgccgttcctcggcttccacgcgctgcccttcaccccggcggatcacggcctgcctccggactgcgagtcgtccgacgccgtacagcccggcgccatcgcgttcctcctcgtggcgttcgagtcgctcgaggccgcgttcgacgactacctcaacaccgccatctccgccgccgccggcggtggccacgacgtctgcgtcgtctccgacccgttcacggcgtggacggtgaccgcggcccggcgccgcggctgcgcgcacgccttcttcgcctcctgcggcgcgtacggcagcgccgtcgtgcactcgctctggagccacctgcccgtccgccccgacccggctaccggccgcgtccacctgcccgagtaccccgaggtcgtaatccaccgctcgcagctctccaagaacgcgtccgccccgcccgccgtcagcaactgcgccgcgggattctacggccggcagatccctctcggctacgagacgggtgcggtgctcgtgaacaccgtggaggagttcgagcccaccggtctcgacatgctgcggcgcaccctcaagatcccggtctggcccatcggccctctcgtgcgcgccgccaacctaccagtctcgccggaggccgaggccgccgtcgcgagcttcctggactgccacccgccgtcgtcggtgctgtacatttcattcggctctcagaactccatacgagcagagcacatggcggagctggcattggcgttagagtcaaccggccggccgttcgtctgggctgtcaggccgccggacggacacgacgtcaagggcgagttccgggccgaccagtggctgccggacgggttcgaggagagggcgcgcacgagcaacagagggctgctggtacgcgggtgggcaccgcaggtgaggatcctggcgcacgcgtcgacgggcgccttcctgagccactgcgggtggaactcagtgctggagagcgtgacgcacggcgtgccaatcatcggctggccgctcgccggcgagcagttctacaatgccaagatgcttaaagaggagtggggagtgtgcgtggaagtggcgagggggaacatggaggatactatggtaaacagggctgcggttgccgacgtggtggagacggtgatgggccagacggcgaaggctgcagagatgcggcggcgcgtgtgggagatcaaggaggtggtggaagggtcctggaacgacggaggcgggtcatcgaggaaggcgatggaggatttcttgcgggcgatgaatctccggtgaagtgaagaacttcgtgtgctgctccgtcttgacctgaatcttgtgcggcattgcaaatgatgctaagttagagcccctttggcggggcactgaacaaagtttctgggccaaatttccaggtagtcgtatgtagggtatcatgcgttgatttgaatgataccattataaatgttacgttttggaaatacactattgttggtttctatatttgtaatcatgtcattacaatttgttatgaaatgatctgtactatctttgtagtattgttggggaccttcggcatccgaaggtcctcaaaaacaggatttaacagtatttctagagtaaaaaaaaaaaaaaaaaaaaaaaaaaaaaaaaaaaaagaaaaaaaaaaaaaaaaa

SEQ ID NO: 96290 - protein, 482 aa, Zea mays
  misc_feature: Ceres CLONE 1597178
  misc_feature (8)..(483): Pfam Name: UDPGT Pfam Description: UDP-glucoronosyl and UDP-glucosyl transferase
  misc_feature: SWISSPROT Homolog: EC 2.4.1.203 Trans-zeatin O-beta-D-glucosyltransferase
MAAAAAAKHVVLFPFPGQGHLSAFMSLAGLLHSALPDAAITFVSTPRNVASLQTSAWSNAPFLGFHALPFTPADHGLPPDCESSDAVQPGAIAFLLVAFESLEAAFDDYLNTAISAAAGGGHDVCVVSDPFTAWTVTAARRRGCAHAFFASCGAYGSAVVHSLWSHLPVRPDPATGRVHLPEYPEVVIHRSQLSKNASAPPAVSNCAAGFYGRQIPLGYETGAVLVNTVEEFEPTGLDMLRRTLKIPVWPIGPLVRAANLPVSPEAEAAVASFLDCHPPSSVLYISFGSQNSIRAEHMAELALALESTGRPFVWAVRPPDGHDVKGEFRADQWLPDGFEERARTSNRGLLVRGWAPQVRILAHASTGAFLSHCGWNSVLESVTHGVPIIGWPLAGEQFYNAKMLKEEWGVCVEVARGNMEDTMVNRAAVADVVETVMGQTAKAAEMRRRVWEIKEVVEGSWNDGGGSSRKAMEDFLRAMNLR

SEQ ID NO: 96291 - DNA, 2679 bp, Zea mays
  misc_feature: Ceres CLONE 1597523
  misc_feature: Encodes the peptide sequence at SEQ ID NO. 96292
agttccgtagaagctttcgtgtactcttcccatccccgccgttgtctctctcttttcccactctcccacacttcctccattgttccctttttctctcgcggagtagcggtgatccagattccagacaccgagtgtcctacgcgtcacggaccgtgcacatggcggcggggtcgatccgggtcaccatggaggtgggcgccgacggtgtcgcgctcataaccatcgccaacccgcccgtcaacgcgctccaccccatcatcatcgccgggctcaaggacaagtacgcggaggccatgcgccgtgacgacgtcaaggccatcgtgctcaccggtgctggaggcaagttctgtggaggatttgatatcaacgttttcacaaaggttcaccagactggggatgtatcacttatgccggacgtatctgttgagcttgtgtcaaatatgatggaagagggaaaaaaaccttctgttgcagccattcaaggtcttgcattgggtggtggcctagagttgactatgggttgtcatgctcggatatctactcctgaagctcaacttggattgccagagctaacccttggcatcatccctggatttggaggtactcagcgtttgccgaggcttgtaggtctacccaaagcgattgaaatgatgctgcaaagtaagttcattgcggcaaaggaagggaaggaacgtggtttgattgatgccctttgctctcctaatgaattgataaagacatcacgtctttgggctctggaaattgctaattgccgtaaaccttggatgagatctcttggcagaacagataggcttgcttcactatctgaagctcgtgctgtattaaatgcagcaagacagcaagcaatgaaggtttcaccaaacatgccacagcaccaggcctgccttgatgtaatggaagaaggcatattatatggaggtcaagctggtgttttgaaggaagccagggttttcaaggaactggtggtagcaccaacatcaaaggctcttgtccatgttttctttgcacaacgttccacgacaaaggtgccaggtgtaactgatgttcaactgaaaccaaggccaattagaaaagttgctgttattggtggtggtctgatgggctctggaattgctacatcacttcttgttagcaatatttctgttgtgctcaaggaagtgaaccctcagtttctgcaaaggggagagaaaatgatagcaggtaatcttgagggcctgataaaaaaaggttcactaacaaaggataggatgcacaaggccatgtcgcttttcaagggcgctttggattattcagatttcaaggatgttgatatggttattgaggctgttattgagaagattcctttgaagcaatcgatattttctgacattgaaaaaatctgtccgaaacattgcatacttgcgacaaacacatccaccattgatttgaatgttgttggcgagaagacaaattctcaagatagaattataggggctcactttttcagccctgctcatattatgcccttgcttgaaattgtccggacggagaagacatcaccacaagctatccttgatctcatcactgttgggaagataataaagaaggtccctgttgtggtcggcaactgcacaggatttgcagtcaaccgtacattttttccttacacacaggcttctcatcttctagttagtcttggtattgatgttttcagaattgatcgagtaataagcagctttggcatgccaatgggaccttttcaactccaagatgtggctgggtatggagtggctttggcagtaaaagatatctacgctgatgcctttggagaaagaaatttgggctctaaccttgtgggcctgatggtaaaggatgggcgacaaggaaaggtgaatgccaaaggttactacatttatgagaagggtgcgaagccaaagccagaccctagtgttaagcatgtgatcgaggagtaccgaaagcaggcaaacacaatgcctggtggaaagcctgttactttaatggatcaagatattttggagatgattttcttcccagttgtgaatgaggcatgcagggttatggatgaaaatgttgtaattcgagcttccgatcttgatattgcttctgttctaggaatgggctttcccaaatacaggggtggtcttgtcttctgggctgacactgttggagcgccttacatacattcgaagctaagcaagtgggccgaaatgtatggtcccttcttcaaaccttcatcgtatttggaacaacgagctaaaagtggtgtaccattgagcgcaccaggaacatcacagcaaggttcggcgaggtcgcgcatgtgaggtgctgtccagcattgggaagaagaattcagaatacttgcggccgggatgagccatagacggctgcttcgcttcgcagatcaaaaacacctccgtgaatacaaataggaggcacagaaatgatgaaaaataaatggttttgcatagctgtaacagttttggtgccttgaactgtaactatggcagagtttctgtgaacagagtggcatgcattaattatacttgaccactctatatgtcgctgtttgtataatttcaatacgtacaagaactaaaatatattattggatagtattttttataataaactcatctgttgctaaaaaaaaaaaaaaaa

SEQ ID NO: 96292 - protein, 727 aa, Zea mays
  misc_feature: Ceres CLONE 1597523
  misc_feature (312)..(491): Pfam Name: 3HCDH_N Pfam Description: 3-hydroxyacyl-CoA dehydrogenase, NAD binding domain
  misc_feature (18)..(187): Pfam Name: ECH Pfam Description: Enoyl-CoA hydratase/isomerase family
  misc_feature (493)..(586): Pfam Name: 3HCDH Pfam Description: 3-hydroxyacyl-CoA dehydrogenase, C-terminal domain
  misc_feature (310)..(588): SWISSPROT Homolog: EC 1.1.1.157 3-hydroxybutyryl-CoA dehydrogenase
  misc_feature (17)..(204): SWISSPROT Homolog: EC 4.2.1.55 3-hydroxybutyryl-CoA dehydratase
MAAGSIRVTMEVGADGVALITIANPPVNALHPIIIAGLKDKYAEAMRRDDVKAIVLTGAGGKFCGGFDINVFTKVHQTGDVSLMPDVSVELVSNMMEEGKKPSVAAIQGLALGGGLELTMGCHARISTPEAQLGLPELTLGIIPGFGGTQRLPRLVGLPKAIEMMLQSKFIAAKEGKERGLIDALCSPNELIKTSRLWALEIANCRKPWMRSLGRTDRLASLSEARAVLNAARQQAMKVSPNMPQHQACLDVMEEGILYGGQAGVLKEARVFKELVVAPTSKALVHVFFAQRSTTKVPGVTDVQLKPRPIRKVAVIGGGLMGSGIATSLLVSNISVVLKEVNPQFLQRGEKMIAGNLEGLIKKGSLTKDRMHKAMSLFKGALDYSDFKDVDMVIEAVIEKIPLKQSIFSDIEKICPKHCILATNTSTIDLNVVGEKTNSQDRIIGAHFFSPAHIMPLLEIVRTEKTSPQAILDLITVGKIIKKVPVVVGNCTGFAVNRTFFPYTQASHLLVSLGIDVFRIDRVISSFGMPMGPFQLQDVAGYGVALAVKDIYADAFGERNLGSNLVGLMVKDGRQGKVNAKGYYIYEKGAKPKPDPSVKHVIEEYRKQANTMPGGKPVTLMDQDILEMIFFPVVNEACRVMDENVVIRASDLDIASVLGMGFPKYRGGLVFWADTVGAPYIHSKLSKWAEMYGPFFKPSSYLEQRAKSGVPLSAPGTSQQGSARSRM

SEQ ID NO: 96293 - DNA, 2300 bp, Zea mays
  misc_feature: Ceres CLONE 1597603
  misc_feature: Encodes the peptide sequence at SEQ ID NO. 96294
aactctcctcccctaaaccctacgctgcccttctttccctccccgtctctccctcccgtgcgggcggcggagctgatgagatcccggccatggcgggccccacctcgcggctcctcatcctcgcccgccgcgccgaccgacgcagatgcctcccttttctcgttccccgcgccttgcaggccgcccccccgaccttttctccggcgttgccgctacctccctgcctccccgcctcaacgccggtgatgagctattcaagtgcatttacaagtgtacatggagagaggccttcatcagaatatgcaaagatcaggaaggagtcactggaaacccagtttggaagaatattgggttcaagttcacgcaggcattttgctgaccgtggctttggtccattccttgctctatacagggctgctactatctcctttcatgttgtaaaactcactatttggcatttgttgctcaatgatatgcataaaagagcagaaaagtttcgagagaccttgatacgcttgggtcctttttatatcaagcttggccaagcattgagcacacgccctgatatacttcctagtgcgtactgtcaggagcttgcaaagctacaggatcaaataccaccgtttccaactcgcattgcactcaggaccatagagtctcagttgggttctcgaatttctgatttgtttgctgatatcagcccagagccgattgcagcagcatcactggggcaggtttacaaagctcatctacgatctggagagcttgttgcagtcaaagttcaaaggcctggaatggcgcccttgctgactctagatgcacttttgttccacatgattggaggacaaatgaaacgatttgctaaggctcgcaaagacctattggtggccgttaatgagattgtcagacacatgtttgacgagattgattatattttagaaggaaaaaatgctgaaaggtttgctactctttattcacatggttcaagtggggtcaattctgaagctagtacaagtatcaaggtcccaaaagtttactggaactatacatgtaaaaccatattgacactggaatggattgatggaattaagctaactgatgctgagcgcatcagcaaagccaatttgaacaggaaaagaatgatagatgagggtctctattgctcattgcgacaactgcttgaagaagggtttttccatgcagacccccatcctggtaatctagttgcaactgaaggtggatctctagcatattttgactttggtatgatgggagatattccgaggcactatcgtgtggggcttatacaaatgcttgtacattatgttaatcgggactccttaggcttggcgaatgacttccattcactaggatttgttcctgagggaacagatttacttgcagttgcagatgcgttgcggttttcctttggtgatgtcaggaggcaatcaaatgatttccagggcgtaatgaaccatttgtatgatgtgatgtatgaatttagtttctcccttccccctgattatgcgttggtgataagagctcttggttctctagaagggactgcaaaagcactggatcctgagtttaaagttattgagagtgcatatccttttgtaattgggagactccttgcagaccccagccctgatatgaggaaaatattgcgggagcttcttatatgtgacgatggatccatcagatggaatcgactggaaaggctgattgcagctatatctgaacagtcatcagaatcttcaagcgcatcaggagctgactccagtgagaacgccaatggaagtcctgagtggagatcatttgatatgcattctgtgattgcagctacagaagacctatttgatttcattttatcgaggaaaggatggcgggttcgggttttccttgtccaggacatcgttaatgcttcagacgtgttccttcaagaagcgacattcccatatgtatatgcgaaagtgggaaagataggggacctaaatccagagagaagtaagatgatcaggaggctggtgaatactgtgcaatcgttccgccaagctatcaatttggctccagatgcttggagcgccatgctaatccgcactttgttgaaacctgaatcacaaaaatttgttcttgatgtgtttttggccctggctaaccattccagttacaagattccagaaacattctggctatttatgtcaagatttctaaattacttggacaaacaagatatactttaggaacggttaatatatcaattccttttttttaaaaaaaaaaaaaaaaaaaaaaaaaaa

SEQ ID NO: 96294 - protein, 717 aa, Zea mays
  misc_feature: Ceres CLONE 1597603
  misc_feature (190)..(316): Pfam Name: ABC1 Pfam Description: ABC1 family
MAGPTSRLLILARRADRRRCLPFLVPRALQAAPPTFSPALPLPPCLPASTPVMSYSSAFTSVHGERPSSEYAKIRKESLETQFGRILGSSSRRHFADRGFGPFLALYRAATISFHVVKLTIWHLLLNDMHKRAEKFRETLIRLGPFYIKLGQALSTRPDILPSAYCQELAKLQDQIPPFPTRIALRTIESQLGSRISDLFADISPEPIAAASLGQVYKAHLRSGELVAVKVQRPGMAPLLTLDALLFHMIGGQMKRFAKARKDLLVAVNEIVRHMFDEIDYILEGKNAERFATLYSHGSSGVNSEASTSIKVPKVYWNYTCKTILTLEWIDGIKLTDAERISKANLNRKRMIDEGLYCSLRQLLEEGFFHADPHPGNLVATEGGSLAYFDFGMMGDIPRHYRVGLIQMLVHYVNRDSLGLANDFHSLGFVPEGTDLLAVADALRFSFGDVRRQSNDFQGVMNHLYDVMYEFSFSLPPDYALVIRALGSLEGTAKALDPEFKVIESAYPFVIGRLLADPSPDMRKILRELLICDDGSIRWNRLERLIAAISEQSSESSSASGADSSENANGSPEWRSFDMHSVIAATEDLFDFILSRKGWRVRVFLVQDIVNASDVFLQEATFPYVYAKVGKIGDLNPERSKMIRRLVNTVQSFRQAINLAPDAWSAMLIRTLLKPESQKFVLDVFLALANHSSYKIPETFWLFMSRFLNYLDKQDIL

SEQ ID NO: 96295 - DNA, 2204 bp, Zea mays
  misc_feature: Ceres CLONE 1597737
  misc_feature: Encodes the peptide sequence at SEQ ID NO. 96296
agtctcgtgcctcatctaacaagtaatcgtcacagtggtagatttgcgctgttacacatcactgcactgcacaggcacagttccacatgggctccatcgttgccgacgccgatcgccggccacacgccgtgtgcgtgccgttcccagcgcagggccacgtgacgccgatgctgaagctagccaaggttctccacagccgaggcttccacatcaccttcgtcaactcggagttcaaccaccgccgcttgctccgctcccgcggcgccagcgcgcttgacggcctcccggacttccgcttcgccgccatcccggagggtctgcccccgtccgacgccgacgccacccaggacgtgccgtcgctctgccgcgccaccatggagaactgcctcccgcatttcaggagcctcctcgccgagctcaactccaacccggacgtgccgccggtcacttgcgtcgtcggagacgacgtcatgagcttcaccctggaagcagccagagaggtcggcgtgccgtgtgcgctgttctggacggccagcgcctgcggctacctgggctaccgctattaccgcgacctcatggagaagggcatcttcccgctcaaagacgccgagcagctgacgaacgggttcttggacacgccgacggactgggcgctggggatgagcaagcacacgcggctcaaggacttcccaagtttcgtgcgctcgacggaccccgacgagttcatgttccacttcgccctgaaggtgacagagcagatagtcggcgcggacgccgtcatcctcaacactttcgacgagctcgagcaggaggcgctcgacgccatgcgcgccatgatcccgtcgtccgcgtccatccacaccatcgggccgctcgcgttcctcgccgaggagatagtgccccgcggaggcccgaccgacgcgctaggctccaacctctggaaggaggacgtgtcctgcttcgagtggctccacggcagggcgcccaggtcggtggtgtacgtgaactacggcagcatcacggtgatgacgaacgaggagctggtggaattcgcgtggggcctggccaacagcggccacgacttcctgtggatcatccggccggacctggtcaacggcgacgccgccgtgctgccgccggagttcctggaagccatcaggggccgcggccacctggcgagctggtgcccgcaagaggtggtgctgaggcacgaggcggtgggcgtgttcctgacgcactgcgggtggaactccaccatggagagcctgtgcgccggggtgccgatgctgtgctggcccttcttcgcggagcagcagaccaactgccggtacacgtgcgtggagtggggcgtggccatggagatcggccaggacgttcggcgggaggcggtggaggagaagatccgagaggcgatgggcggggagaagggaatggagatgcagcgccgcgcgggggagtggcagcagattggtctccgcgcgacgcggccccgagggcgctcatacgccaacctcgacaagctggtcgccgacgtgctcctctcgggtactagcggcaagagttcttaaaatctcaggagggtttcacttcgcacaccgccaccgtccaatgattcggactgaacatggatggtatggtagtacaccaaaagagaagtttgtgtgaatgttgaggcaaacccgtaaatcatggagcatgtgatggaatggaaggaccgaaggagccagtagcggaagaagttacttctcgtagcaggcaaaaattggaatatgaaaacctggaagccaagagggttaatccctaattactatattttctatctgctagctgtattcgttgcaaatgcacmcggtctgctgtttgtacgagtgtctggtagacacatctacgcttaattaggttttgtccaatttttatttagtaattacataaaaaatcaaagatcaaagttaatactaggtgtaatttatgggggtcttaatatgatctaaccgatggtttgataagggttaggtacacaatgatactatagtgtgttgtttggttggtccattttactttgtaaaccgttaacagtatccaataacggtagtttatgtttgtttttggttcactgtaatcaaatcacgatgggatttgttaccggcatatgtaaatttgataccgcctatttcctagagttaggctaaaaaaaaaaaaaaaaa

SEQ ID NO: 96296 - protein, 493 aa, Zea mays
  misc_feature: Ceres CLONE 1597737
  misc_feature (14)..(487): Pfam Name: UDPGT Pfam Description: UDP-glucoronosyl and UDP-glucosyl transferase
  misc_feature: SWISSPROT Homolog: EC 2.4.1.121 Indole-3-acetate beta-glucosyltransferase
MGSIVADADRRPHAVCVPFPAQGHVTPMLKLAKVLHSRGFHITFVNSEFNHRRLLRSRGASALDGLPDFRFAAIPEGLPPSDADATQDVPSLCRATMENCLPHFRSLLAELNSNPDVPPVTCVVGDDVMSFTLEAAREVGVPCALFWTASACGYLGYRYYRDLMEKGIFPLKDAEQLTNGFLDTPTDWALGMSKHTRLKDFPSFVRSTDPDEFMFHFALKVTEQIVGADAVILNTFDELEQEALDAMRAMIPSSASIHTIGPLAFLAEEIVPRGGPTDALGSNLWKEDVSCFEWLHGRAPRSVVYVNYGSITVMTNEELVEFAWGLANSGHDFLWIIRPDLVNGDAAVLPPEFLEAIRGRGHLASWCPQEVVLRHEAVGVFLTHCGWNSTMESLCAGVPMLCWPFFAEQQTNCRYTCVEWGVAMEIGQDVRREAVEEKIREAMGGEKGMEMQRRAGEWQQIGLRATRPRGRSYANLDKLVADVLLSGTSGKSS

SEQ ID NO: 96297 - DNA, 2217 bp, Zea mays
  misc_feature: Ceres CLONE 1598429
  misc_feature: Encodes the peptide sequence at SEQ ID NO. 96298
agcaagcgccgccgacctccccacctcggcttctgtctatccctcgacaaaccgacctctcccgccgccgaccgccgtcgatctaccgatcggccggacgaaagacccacctctccccaaaataggcggctgagacatacgttcctatctccccttcgctgccggagaaaagcctcgcagcctgcccctccctcaccttcacctcgatttctctgggcctccgaaccccgccgacaggagcgttccagcatctcctatcccgtgccgcgtacgtctgcacggattagcgttccttctattggtaagtaggtcacataatgtcttctgaagataaagcaatggctaatcgtgtcacttcacactcgccaaaagctatggtgtcggaaccagatcccaacaggatgatgatgtttagatcaaatatggagtattcacaaacaaatggccagacaaatgctgttcttggtcctgtggctatcttttgggacattgagaactgtcctgttccatgtgatgtacggccagaagatgttgctggcaatgttaggatggctttgcgcatgcatcctgttgttaggggtgcggtgacaatgctgtctgcttatggagatttcaatgctttcccaaggagactccgggagggatgccagagaactggagtcaaacttgttgatgttcctaatggacggaaagatgctgctgataaggctatactggttgatatgttcctttttgcacttgacaatcacccaccatcatccattatgctcatatctggtgatgtggacttcgctccggcattgcatatacttggccagcgtggatacaccattgtcattgctattccgtcttcagttaccgtctcatcagctctgagcagtgctgggagtttcgtgtgggactggcctagccttgcccgtggtgaaggtgttgtgatccctaggtccttggtgcgccgtctggctgattatccatgttatgtcaacagtgggaatatgggacagttccctgataatcagaatgaagaggaggccattgtatataccggaacatcaaggaatgaatatggtggcagacctcccgtcaatcaaatgtattgttataacacttcccagacaactagagaaccaagcaaagctttgtatactgttgaagatgtgaactgtggtacatcatcaaggcctcataatttatcatgtcgtcagagtgaaagtcctgagacagaccaaggtttgacagatgagcagtcatggtgggttcgtcctggtgatcttcaaggattgaagggtcaactaatacgtctgtttgaattatctggaggatgtgtcccacttgttcgtattccctcagagtatctaaaactctttggcagacatttatatgtatcagaatatggagctgttaagcttgttcatcttttcgagaagctggccgactcttttgttgtcgttggtaagggtcataaaaagatgatctgtctctgcaattctggtgataggaacctgaagaattatccaagtacgccaatcattctgacgaagaaaaacagaggaaattctgctcttgaagaaagcacgataggagcatgtcagcaattaggcagctcatcagatgaattatcagaggataaaccaattatcaacccagatataaatgttgcatgtgtgttcaatgagcatctagacagcttcagaagggagattcaggagctccttgtttgctactcctgccctgttccgcttggtaattttgagagtttatatgagcaacggtataagaagatcattgactatgagagcttaggagtcaccggtctggaggagctagttgagaaggtgaaagacgtggtagatttgcacgaggaccaaaccagcaaaagcaagttccttattgcaaactacacaaccggttaggctctttctgttgtcttgatgtcctagttcagctcctaaagtacttcagctcgtgtttccttaacatgtgtcacacagggtcggcatctttttttaccgtgccggtatgataagtgtgaatggcatagtaagtatttgtaatggcttccctcatgcctcagctaatctgtgcaaacagggagttgtttcttgtatgcaaaaagatgattatactaaagaacagtgaccatttatttggcaaataaaaaaaaaaaaaaaaaaaaaaaaaaaaaaaaaaaaaaaaaaaaaaaaaaaaaaaaaaaaa

SEQ ID NO: 96298 - protein, 531 aa, Zea mays
  misc_feature: Ceres CLONE 1598429
  misc_feature (50)..(199): Pfam Name: DUF537 Pfam Description: Protein of unknown function, DUF537
MSSEDKAMANRVTSHSPKAMVSEPDPNRMMMFRSNMEYSQTNGQTNAVLGPVAIFWDIENCPVPCDVRPEDVAGNVRMALRMHPVVRGAVTMLSAYGDFNAFPRRLREGCQRTGVKLVDVPNGRKDAADKAILVDMFLFALDNHPPSSIMLISGDVDFAPALHILGQRGYTIVIAIPSSVTVSSALSSAGSFVWDWPSLARGEGVVIPRSLVRRLADYPCYVNSGNMGQFPDNQNEEEAIVYTGTSRNEYGGRPPVNQMYCYNTSQTTREPSKALYTVEDVNCGTSSRPHNLSCRQSESPETDQGLTDEQSWWVRPGDLQGLKGQLIRLFELSGGCVPLVRIPSEYLKLFGRHLYVSEYGAVKLVHLFEKLADSFVVVGKGHKKMICLCNSGDRNLKNYPSTPIILTKKNRGNSALEESTIGACQQLGSSSDELSEDKPIINPDINVACVFNEHLDSFRREIQELLVCYSCPVPLGNFESLYEQRYKKIIDYESLGVTGLEELVEKVKDVVDLHEDQTSKSKFLIANYTTG

SEQ ID NO: 96299 - DNA, 1966 bp, Zea mays
  misc_feature: Ceres CLONE 1598463
  misc_feature: Encodes the peptide sequence at SEQ ID NO. 96300
aaacctcgcaagctagctagctactactcatgccctcctacgctctgctccctactcctcctctccctttcggctcccgatcccttcccgcgcgcgcacgtcgtccttcccgattcgctccgacgacccaccgccgtgccgtcggctggatatagctgcccggttcgacccagcgcgccattaaaacacctctttcctcatcgaccggccgcgccaagcgcatagaccagcacgtacggtaccagtaccacacgtctacgcgaacgaccgaccggcgcattccatcgtccatgggcaaccgcaagaagctggtccacttcctccgcgtcgacccggcggcggcggcagcggcctccgccctctcctcccctaggtccttctcctccttctccgacgacgacggctacagctcctcctccttctcctcctcctcgccgtcgcggtacagcccgcccaagtcgccgtgggcgcgcctcccgggcctcggcggcgccggcgccggcgccgaagacgctgccgcgacaggcctcatcgcgtcgctcgtcaaggaggacggcaaggtctactcgctggcggcggccggggacgtgctgtacaccggcacggactcggagaacgtgcgtgtgtggcgggaccggtgcgagctcgcggggttccggaccggcagcggcctcgtcaaggccatcgtggtcgcctccgacggccgcatcttcacgggccaccaggacggcaaggtccgggtgtggcgcgccgacgccgccgtgcaccgccgcgtggggtcgctcccgcccctcggggacctcctggtcagctccgtcaacccgtccagctacgtgcgctcgccgcgcggcgggaggggccggcgccgcgtcgccgtctggctccgccactcggacgccgtgtcgtccctcagcctcgacgagggcgccggcctgctctactcggcctcctgggaccgcaccttcaaggcgtggcgcgtgtcagactaccggtgcctcgagtccgtgcccgcgcacgacgacgccgtcaacacggtcgccgcggccgggttcggcggcctcgtgctcaccggctccgccgacgggaccgtcaaggtgtggcggcggggggaggcggcggccgaccggacgaggcacgtcctgcagacggtgctccgggagggcgacggcgcggtgaccgccatcgcggcgtgccccgaggcccgcgccgtgtacgtgggctcctccgacgggctggtcacgtgctggcggtgggggctggacgtggacgcccagccgacgcacgcgggcgtgctggccggacacgggatgggcgtgctgtgcctcgccgtgtccgggcgcgtcgtcgtcagcggctcggccgacgggacgctctgcgtgtggcgccggaacgacgacgacgacgagcaagagggacacgcccacctcgccgtgctcgcggggcacacggggcccgtcaagtgcgttgcagtggccgcggacgaggactgctacgacgcggacggcgagcggcggttcgtggtgtacagcggcagcctggacgggtcggtcaaggtgtggcgtctgtcggaggagcgcgcgctggagccgcccgcggtagagacaacaacgcctccgttgatggcggcactgaggcagtcggagacatggatgccccggccccgaacagcacagcttccgtcaccggtgcaaacgtgggcgccggagctgaagggcgtggcagctgcttgagcacgattgcacgaagaagctaccggtcgattagctgcacctgcactgcatgaggtcgtgcgcgtgtgcgtgcaagaatgtgccgccaacacgtgtgctgtaggagagtgtgtacatatacctagaacatacggataccgtatggtattggtaactacgcctagctagtatgaattttgaggaggattaaatcaagtgtggagtgccgggtttttttccaaaaaaaaaaaaaaaaa

SEQ ID NO: 96300 - protein, 479 aa, Zea mays
  misc_feature: Ceres CLONE 1598463
  misc_feature (233)..(271): Pfam Name: WD40 Pfam Description: WD domain, G-beta repeat
  misc_feature (376)..(424): Pfam Name: WD40 Pfam Description: WD domain, G-beta repeat
  misc_feature (329)..(365): Pfam Name: WD40 Pfam Description: WD domain, G-beta repeat
  misc_feature (191)..(229): Pfam Name: WD40 Pfam Description: WD domain, G-beta repeat
  misc_feature: SWISSPROT Homolog: EC 2.7.11.7 [Myosin heavy-chain] kinase
MGNRKKLVHFLRVDPAAAAAASALSSPRSFSSFSDDDGYSSSSFSSSSPSRYSPPKSPWARLPGLGGAGAGAEDAAATGLIASLVKEDGKVYSLAAAGDVLYTGTDSENVRVWRDRCELAGFRTGSGLVKAIVVASDGRIFTGHQDGKVRVWRADAAVHRRVGSLPPLGDLLVSSVNPSSYVRSPRGGRGRRRVAVWLRHSDAVSSLSLDEGAGLLYSASWDRTFKAWRVSDYRCLESVPAHDDAVNTVAAAGFGGLVLTGSADGTVKVWRRGEAAADRTRHVLQTVLREGDGAVTAIAACPEARAVYVGSSDGLVTCWRWGLDVDAQPTHAGVLAGHGMGVLCLAVSGRVVVSGSADGTLCVWRRNDDDDEQEGHAHLAVLAGHTGPVKCVAVAADEDCYDADGERRFVVYSGSLDGSVKVWRLSEERALEPPAVETTTPPLMAALRQSETWMPRPRTAQLPSPVQTWAPELKGVAAA

SEQ ID NO: 96301 - DNA, 2358 bp, Zea mays
  misc_feature: Ceres CLONE 1598488
  misc_feature: Encodes the peptide sequence at SEQ ID NO. 96302
aacctgtacgccgtcccgcttcgcttcggagaggtcgctgcctgccatcaacgttccctcgctggtagagtagaggtagacccaccgacccccagtactagtcgggagagagatggggattgatctcaacgccgtgggggaggacgacccggcgggcgcggtgtgcgcggagctgtggcacgcgtgcgcgggggctggagtggcgctgccgcggcggggcagcgccgtggtgtacctgcctcaggcgcacctcgcggcgggcggctgcgacggtggtgggatgtcggcgccggccccgccgcgcgtgccgccgcacgtggtgtgtcgcgtcgtcgacgtcgagctacgcgcggatgcggccacggacgaggtgtacgcgcggcttgcgctggtggcgatggatacgatgtttggccgaaacatcaatgatggtgaaactgaagagaagaatggcgaggaagaggatggcgacggagaaaagaagcacgcatcacacatgttctgcaagacactcacagcttctgataccagcacacatgggggattctctgttccacggcgagctgcagaggactgctttccacccttggactatgagcagcttaggccttcccaagagcttattgccaaggatttgcatggcatgaaatggaggttccgtcatatctatagaggtcaacctcgaaggcatcttctgacaactggatggagttcatttatcaataagaagaaactagtctcaggggatgcagtcttgtttcttagaggtaatgatggtgagctaagattgggtgtgaggagagcagttcaactgaaaaatgaagctctacttgaagctgtcaactgtactgattcgaagctacttatgctgtctgctgtcgccaattctttggacaacagaagtatatttcacatctgtttcaacccaagggttggtgcatcagaatttattgtgccgtattgcaagttcttgaagagtttgaactatcccttttcagttggaaccagatttaaagttggctgcgagaatgaagatgctaacgagaggtcctttggattgatcataggtattagtgaagttgatcccatacactggcctggatcaaaatggaaatctctcctgataaagtgggatggtgctactaagtacagccaccagaatagagtatctccatgggacatcgagggagttggcagctcagtttcagttactcaccgtctttcctcttctgtttcgaagcgaacaaaactgtgcttccctccaagcgatttggacacgccaattctagatggaaatggtcgtccagactccgtggaaactgaacgtttccacagggtcttgcaaggtcaagaattggtgcactctagtattcacggtgctgcatgctctcattcatcagatagccccagatgtcaaggctcttatggcaggagattctctgctgatgcatggaactgcaagatgaatgatgtaatgagtgggcctcgacacctaaatgccactgggtttgcttaccagcccctaggcttcagtgaatctgtcaaattctcagaggtcttgcaaggtcaagaaatgtctcaggcggttccttccttcatgagatctgctttcaactctggcacgcagaatggcagggttcgaccatttgattatgtgcagagatcagatgcaactcaaggatacgctctccagcagtttaatctgccagcaacagaagtgcattcgccctcttctgttcttatgtttaaccaaaccatggtaccacatgctgagctagatggtgcgaccaaccgtgaagaagtacatggcagcaggtacttgtcatccaatgcaatagggagagaagctgaaccatggccatccatggagcagcaaagagcgagtgtaaatggaagcgagcctctcgacacaactgaagcctcagctcctgcaaggaacgctgaatctggatcggtcggcaggggcgtggggcgaagcagctgtaagctttttggtttctccctgactgagaagatccttgcaacggatggtggtggtgtaaaagaaggaaactacgaagtggaccgtcaaactccccgggtgctagacttgtttgggcacggttctacgcctggtgctctgcatgctctctgtgctgctcccttgggaatatgatgctgttctgcctagttttacagcagttagatttatgtaatccttcagccattttcatcgcgttgtacttgaccaatatgtccagcgtatgatttccagttttaattgtatgctgatgctacatatcctctcttgagatccatgcatgagaattctggcagaatgaataaaggtaaattgatgtccaaaaaaaaaaaaaaaaa

SEQ ID NO: 96302 - protein, 680 aa, Zea mays
  misc_feature: Ceres CLONE 1598488
  misc_feature (256)..(337): Pfam Name: Auxin_resp Pfam Description: Auxin response factor
  misc_feature (129)..(234): Pfam Name: B3 Pfam Description: B3 DNA binding domain
MGIDLNAVGEDDPAGAVCAELWHACAGAGVALPRRGSAVVYLPQAHLAAGGCDGGGMSAPAPPRVPPHVVCRVVDVELRADAATDEVYARLALVAMDTMFGRNINDGETEEKNGEEEDGDGEKKHASHMFCKTLTASDTSTHGGFSVPRRAAEDCFPPLDYEQLRPSQELIAKDLHGMKWRFRHIYRGQPRRHLLTTGWSSFINKKKLVSGDAVLFLRGNDGELRLGVRRAVQLKNEALLEAVNCTDSKLLMLSAVANSLDNRSIFHICFNPRVGASEFIVPYCKFLKSLNYPFSVGTRFKVGCENEDANERSFGLIIGISEVDPIHWPGSKWKSLLIKWDGATKYSHQNRVSPWDIEGVGSSVSVTHRLSSSVSKRTKLCFPPSDLDTPILDGNGRPDSVETERFHRVLQGQELVHSSIHGAACSHSSDSPRCQGSYGRRFSADAWNCKMNDVMSGPRHLNATGFAYQPLGFSESVKFSEVLQGQEMSQAVPSFMRSAFNSGTQNGRVRPFDYVQRSDATQGYALQQFNLPATEVHSPSSVLMFNQTMVPHAELDGATNREEVHGSRYLSSNAIGREAEPWPSMEQQRASVNGSEPLDTTEASAPARNAESGSVGRGVGRSSCKLFGFSLTEKILATDGGGVKEGNYEVDRQTPRVLDLFGHGSTPGALHALCAAPLGI

SEQ ID NO: 96303 - DNA, 2133 bp, Zea mays
  misc_feature: Ceres CLONE 1598693
  misc_feature: Encodes the peptide sequence at SEQ ID NO. 96304
aatctttccacccttcttctacctccttccacccccttctccccacgccccatcggatcgcacgcgccctgcaattgttgtgttgttcatcacctctccgaagaagcgtcacagagcaccgcccggaggttccccttcccgtcgccgtcgccgtcgcttggccaagatggctgaacaattctataccgtggcatcggatagtgaaaccactggtgaagacaaatcacagccttcattccctgatgttgctgttggcattgacattgggacttccaaatgcagtgttgctatttggaatggccaccaagttgagctcttaaagaatacccgtaatcagaaagggatgaggtcatatgtcatgttcaaagatgatactctttcagcaggagttactggaggtgcagccaaggaaaatgcacacgaggaaagagacatcttgtcaggaagtgccatattcaacatgaaacgcctgataggaagaatggacactgatgaagtggttcaagctagtaagaccctcccatttcttgtgcagacattgggtatcggtgtgagaccattcattgcggccctggtgaacaacatgtggcgatctacaactccagaggaggtccttgccatctttctacttgaattgaaggccttggtggagatgcaccttaagcatcccgttaggaatgctgtgcttacaataccagttgcgttcagtcggtttcaacagaccaggattgagagagcctgtgcaatggctgggctgcatgtgttgaggttgatgccggaaccaactgctgtggcgcttctgtacgctcagcagcagcagcagcttgtgcatgacaatatgggaagcggcatcgagaaaattgctctgatatttaacatgggtgctgggtactgtgatgtggccgtggctgccacagctggaggtgtttctcagataagagcattatcaggatgcacagctggtggggaggatatacttcagaacataatgcgccatgttcttcccaattttgacggtatatatgctggccagacaatggatagaatcaagtcgatgagcttactgcgaattgctactcaagatgcaattcacaggctcgttagtcaagaatccgtggagatcaatatagatttggggaatggccacatggtgtccaaagttctagaccattcagagtttgaacaagtcaaccgggcaattttcgacaagtgcgaaaagatcatcaaccagtgcttggctgatgcgaagttggtaccagaggacatcaatgatgtcatactggtcggaggttgttcgaagatccccagaatcagaagccttgtcctgggtttgtgcaagaaggaggtctcctacaagaacatagatgctctagaagctgctgtttcaggtgctgcgctggaaggagccatcgcttcgggagtaaatgatccttcggggagcttggatcttctcacgatccaggcaactcccatgaacctgggaatccgtgccgacggtgatagcttcgctgcgatcatccctaggaacacgacggttccagcaaggagggacatgctgttcacaacgacacacgacaagcagaccgaagccctaattgctgtgtatgaaggagaaggggaacgtgctgaagataaccatctgttagggtacttcaagatcactggaattccggcagcccctaagggagcagttgatatcagtgtatgcatggacatcgatgctgccaatgtcctcagggtgttcgcaggggtcgtgaagcctcaaggcccagccattccaccgttcatcgaggtgaggatgccaacgctggacgatggccatggctggtgtgggcaagctctagcaaagatgtatgggaagactctcgaccttgctgttcttccgaagaagctgcagccatgatatgtgccttccgtggcccgtaaagtagctggtgcgttgtgcgaatgtaggctgctcagtgttcagtattcactgtgtcactgtcccctgtggtgtggccactgtttatgtgctgttggtgttgggcagtctacagaactgaactaccagtttcatccttgtaggcgtgtacaataatgtcccgtgcatgtgaaatgaatgttgcggatgtttaaaaaaaaaaaaaaaaa

SEQ ID NO: 96304 - protein, 578 aa, Zea mays
  misc_feature: Ceres CLONE 1598693
  misc_feature (28)..(578): Pfam Name: HSP70 Pfam Description: Hsp70 protein
MAEQFYTVASDSETTGEDKSQPSFPDVAVGIDIGTSKCSVAIWNGHQVELLKNTRNQKGMRSYVMFKDDTLSAGVTGGAAKENAHEERDILSGSAIFNMKRLIGRMDTDEVVQASKTLPFLVQTLGIGVRPFIAALVNNMWRSTTPEEVLAIFLLELKALVEMHLKHPVRNAVLTIPVAFSRFQQTRIERACAMAGLHVLRLMPEPTAVALLYAQQQQQLVHDNMGSGIEKIALIFNMGAGYCDVAVAATAGGVSQIRALSGCTAGGEDILQNIMRHVLPNFDGIYAGQTMDRIKSMSLLRIATQDAIHRLVSQESVEINIDLGNGHMVSKVLDHSEFEQVNRAIFDKCEKIINQCLADAKLVPEDINDVILVGGCSKIPRIRSLVLGLCKKEVSYKNIDALEAAVSGAALEGAIASGVNDPSGSLDLLTIQATPMNLGIRADGDSFAAIIPRNTTVPARRDMLFTTTHDKQTEALIAVYEGEGERAEDNHLLGYFKITGIPAAPKGAVDISVCMDIDAANVLRVFAGVVKPQGPAIPPFIEVRMPTLDDGHGWCGQALAKMYGKTLDLAVLPKKLQP

SEQ ID NO: 96305 - DNA, 2932 bp, Zea mays
  misc_feature: Ceres CLONE 1598746
  misc_feature: Encodes the peptide sequence at SEQ ID NO. 96306
agtctgtgagcgcatatgctgccgtcgagtcgggaacgcatgcgccgccttctcccgccgctcgctgtccacccgccgccatgcctcccagcacctcctccaaccgccggcggcggaagcgccctcgccatcccggagttgattcctctcctggaacgggccatctcaatgggggacgtgctccatctcggccgcgcggtgcacgcgcacctcgtcaagacggcgctcaccagccatacgctcctatcaaatcgtctcgtcgcgctctactcctcgctcccgtcgccggccgctgccgtcaaggccttctacgaccttccacacaagaacgcgcactcctacaacacgcttctcgctgcgctcttgcgcaggccggacaccctccccgacgccttccgcctgttcgacacaatgccggccgactcacgcaacctcgtctcctacaacaccctcatgtcgtcccttgcgcaccacggccggcaggtggaggcgctccgcgtcgttgcccggctggccagggacaggttcttggggccaggtttagccatggatcggttcacggtggtcagcgtggcgactgcatgtgcgggaatcggagctgcgaggccgctgcgggaaatgcacggtgcggtagtggtatcagggatggagttcaccgtcatcatggccaatgccatgttgaacgcctacagcaaggctcggagggtggaagatgcgaggcatttgttcgatcaggtcagcatccgagacaatgtcacttggacgtcgatgatttctgggtactgccaagtgaagaagctccatgaggcagtgcaggtgttcgatatgatgccagataaggataggattgcatggacagcgctgatatctgggcatgagcagaatggagaggaggacaccgctcttgagcttttcgaacagatgctggccaagggagtatcaccaacgccttttgtcttggtgtcagctttgggtgcatgtgccaaacttggacttgtcacacgtgggaaggaattgcactgcttcatcttacgccggaacattggctctgtccctttcaacattttcatccacaatgcactcgttgacatgtactctaagtgtggagacatgatggctgcgatggcagtatttgactggatgcctgagagggactttatctcttggaactcaatggtcacggggttctcacataatggcctcggaaagcagtcacttgctatttttgaggagatgctggtagctggagttcgtccaactcatgtcactttcctcgctgtcctcacggcctgcagccattctggtctagtatctaatggacgactcgttcttgaatcaatggaggaccatggtgttgaaccaagggctgaacactatgctgccttcattgatgctcttggtcggaatcaccagctggaagaagcgactgagttcatcaaagatttgccatccaggattggtcctggtacagctggatcctggggagctctcctaggtgcatgtcgccttcatggaaatatcgagcttgcagaagaagtggcagagtttctcttcaggttagagcctgggaacagtggtcggtatgtcatgatgtcaaacatctatgcagctgcaggacagtgggatgatgcacgtcgagtcagggggctcatgaaggagaagggccttaagaaggatcaggcttacagttggattgaggtgcggagtgcaaagcatgtattcgttgctgatgacatctctcattgcgaggcagacaagatatatgagatgttggggaagcttctcgaccatatgagcgtagcagaggatcctactgaacaccagcttaatttttgtttagacttgagtggaactgcccatgtataaaagcattgctcttgtattgctggcacactgctatggtgatggtaggcggggttcgctcccttgccaccagcatcctcgtggcactctgttaagctttgtgagactgcaaaatagctcgagccaagggcttctgttcgtgcagagttttcaatctccagtttgagagctcaagtgctcaacgaggtttacccagagaatcatctgcagttgattcaacgttccaagtcttgggtcatggtgtaatctgtcaggcttcaatcacagcagaagttgcaagagtttgatccaatccagtttgagttccttgagttcacaatccaatattcatgtgccctgtgctgtcagctgatctttcccttttcataaaaaaagattgtttcctgagaatggtaattctacgttagaaggttcagagattctgatttagtttaaattgtatatggtacctgttggggctctgactttggataaacacagtccccggggagttgaagaacaattatctactctttacttgatatacattttcaggagtatcttcgctcaaaaaagaaacaaataatatggcgaaggcgaatggttacttcacctgaacacgaagactcaaagcagagattgaagtcaaatcttcctctttgtcggtgatcaagcgaagcccacaagatatacttcgccgagaagcgaagtcaaaattgaacgaagttagattagtccactccaaggcatgatgcttctctgaccaagattatcttagttgatgatcaagtgaaccaacaattgtcgatgtttcgagtgagtgtctgactagtaaacttgtgctacacgttttaaggccgagatggtgtgcaagtaggacacaaggattatactggtttgaacgaaatgtcactactacagtcttgttagcttatgctagcggcactatattgcttgtagtaggagttacaagctgggcagtaggagttacaagctggacgagagagggaaaaactcgtaagtctctgatgcgagtgtgtgtgttcatgtgttgcctcgtgttctccaaaaaaaaaaaaaaaaaaaaaaa

SEQ ID NO: 96306 - protein, 616 aa, Zea mays
  misc_feature: Ceres CLONE 1598746
  misc_feature (278)..(312): Pfam Name: PPR Pfam Description: PPR repeat
  misc_feature (382)..(416): Pfam Name: PPR Pfam Description: PPR repeat
MLPSSRERMRRLLPPLAVHPPPCLPAPPPTAGGGSALAIPELIPLLERAISMGDVLHLGRAVHAHLVKTALTSHTLLSNRLVALYSSLPSPAAAVKAFYDLPHKNAHSYNTLLAALLRRPDTLPDAFRLFDTMPADSRNLVSYNTLMSSLAHHGRQVEALRVVARLARDRFLGPGLAMDRFTVVSVATACAGIGAARPLREMHGAVVVSGMEFTVIMANAMLNAYSKARRVEDARHLFDQVSIRDNVTWTSMISGYCQVKKLHEAVQVFDMMPDKDRIAWTALISGHEQNGEEDTALELFEQMLAKGVSPTPFVLVSALGACAKLGLVTRGKELHCFILRRNIGSVPFNIFIHNALVDMYSKCGDMMAAMAVFDWMPERDFISWNSMVTGFSHNGLGKQSLAIFEEMLVAGVRPTHVTFLAVLTACSHSGLVSNGRLVLESMEDHGVEPRAEHYAAFIDALGRNHQLEEATEFIKDLPSRIGPGTAGSWGALLGACRLHGNIELAEEVAEFLFRLEPGNSGRYVMMSNIYAAAGQWDDARRVRGLMKEKGLKKDQAYSWIEVRSAKHVFVADDISHCEADKIYEMLGKLLDHMSVAEDPTEHQLNFCLDLSGTAHV

SEQ ID NO: 96307 - DNA, 2525 bp, Zea mays
  misc_feature: Ceres CLONE 1598869
  misc_feature: Encodes the peptide sequence at SEQ ID NO. 96308
agtctctctgttctgagtgcttcctggtggaaagcttcaagatctagaagatcgccattggcaagctaagctagtggtggtgggtgccgtgatgaagcgtgcgtgcatgggtgcgtaacacgtccaagcaagcgagctggcctgtgatttgcaaatggaagacgacgagatcagcgagctatatctgctgagccgcttcgcgccatcctcgtccaccactcatcagcagaggcttgcagagatgcccatggatcaggacctgtcctcggagctggacccggcgctggtcatgtcgacgtcgacgtcctcctcgtcgccaccggactcggcggcctcgccctcctcctccttctccctcccatcaccgccccgctacacctttgccgtcaacaacctctcgtgccccgcccctcgccgccgcgccgccaacctcctaccgtcgttcctgtcctactcctcctccgccgccgcttcgccgacccccgatgccgccggcgcggcgggcctgctcaagtccgtgtccttcaccgcgtccagctccaacatcctcgctgtcgtgggtcccagcggcgccggcaagtcgacgctgctccgcatcctgtccggccgcggcacgggctccgagatcgccaagcccggcacggtgtcgctcaacgggcacgcggtcacctcccgcgcgcagctgcggcggctctgcggcttcgtcacgcaggacgacaacctgctgccgctcctcacggtccgcgagaccatcctcttcgccgccgggttcaggctccgcgccgccgcgacagccgcggagcgcaacgagcgcgtggaggcgctcatgcaggagctcggcctgtccgacgtcgccgacagctacgtcggtggcggggacggctgcggcgggccgtccgccgcccgcggggtgtcgggaggcgagcggaagcgggtgtccatcgcggtggacatcgtgcacaacccaccggtgctgctgctggacgagcccacgtcggggctggacagccggtccgccctggacgtgctgcagctgctgcacgacgtgtcccgcgcgcggcgccaggtggtggtgctcagcatccaccagcccagctaccgcatgctgcactacatctcctcgctgctcctgctctcccgcggcgccgtcgcgcacgtcggcacgctcgcgtcgctggaggacgcactggcgcggctgggccacaagatccccatgcagctcaacccgctcgagctcgccatggaggtcaccggccagctcgaagaggacagcagctccaggatcgccgagcacggtgccgacgacgaggatgaggtgagcggccttgtcggtggacgacgcctcgacgtcccggaccaaggctactgcagccgcttcacggaggtggcaacgctgaccgtgcgctgctggcgcaccatgtaccgcacgcgggagctgttcgcggcgcgcgccgcgcaggccgtggtgggcggcctcggcctcggcagcgtctacttccgcctcagcccggacagccccgacggcgtggcgctccggctgggcctcttcgccttcaccctcagcttcctgctctcgtccaccgtggaggccctgcccatcctgctccacgagcgccgcgtgctgatgcgggaggcctccaggcgcgcgtaccgcctctcctcctacgtgctcgccaacgcgctcgtcttcgcgccgtgcctcctcgccgtgtcgctcctcttctcggcgcccctctactggctcgccgggctccgcgccacgccgctcgccgccttcgccttgttcgtccttgccgtctggctcatcatgctcatggccagctccctcgtgctcttcctcagcgccgtgtcgccggacttcgtgctcgggaacgccctcatctgcgtgttcttgggcgtcttcttcctcttctccggctactttatccccaaggacaacatcccgaggtactgggcgttcatgtactacgtgtccatgtacaggtacccgctggacctgctgctcatcaacgagtacgggggcagcgcaaggggcaggtgcgtggcgtggatggcaggaaaaaatgacgccatgcccggaggcgtgtgcttgaggaccggagccgacgtgctcagggacaggggaatcgacgaggggatgaggtgggtcaacgtcggagtcatgctgggcttcttcctgctctacaggatcttgtgctgggctgtgctcgtcaggagggcctccaagaccaccctgtgatcgtgatcttttcagggagcagggttaggtcgattccggcgaacagctgtgtgtctcatcatgcatcattttctgtttggaggtgaagagagtcattggttgattaaattggttcatgtaattattccagtaatatctaatgttgtattcctttactttgaaacttttttcctatattttgggactggtgttgagtaaaagtaatgttaatccgcggcgtgctgtggaatctgaatatattttcggtaatcaatcacagttatttcaataaaaaaaaaaaaaaaaa

SEQ ID NO: 96308 - protein, 694 aa, Zea mays
  misc_feature: Ceres CLONE 1598869
  misc_feature (409)..(621): Pfam Name: ABC2_membrane Pfam Description: ABC-2 type transporter
  misc_feature (129)..(330): Pfam Name: ABC_tran Pfam Description: ABC transporter
  misc_feature: SWISSPROT Homolog: EC 3.6.3.28 Phosphonate-transporting ATPase
MEDDEISELYLLSRFAPSSSTTHQQRLAEMPMDQDLSSELDPALVMSTSTSSSSPPDSAASPSSSFSLPSPPRYTFAVNNLSCPAPRRRAANLLPSFLSYSSSAAASPTPDAAGAAGLLKSVSFTASSSNILAVVGPSGAGKSTLLRILSGRGTGSEIAKPGTVSLNGHAVTSRAQLRRLCGFVTQDDNLLPLLTVRETILFAAGFRLRAAATAAERNERVEALMQELGLSDVADSYVGGGDGCGGPSAARGVSGGERKRVSIAVDIVHNPPVLLLDEPTSGLDSRSALDVLQLLHDVSRARRQVVVLSIHQPSYRMLHYISSLLLLSRGAVAHVGTLASLEDALARLGHKIPMQLNPLELAMEVTGQLEEDSSSRIAEHGADDEDEVSGLVGGRRLDVPDQGYCSRFTEVATLTVRCWRTMYRTRELFAARAAQAVVGGLGLGSVYFRLSPDSPDGVALRLGLFAFTLSFLLSSTVEALPILLHERRVLMREASRRAYRLSSYVLANALVFAPCLLAVSLLFSAPLYWLAGLRATPLAAFALFVLAVWLIMLMASSLVLFLSAVSPDFVLGNALICVFLGVFFLFSGYFIPKDNIPRYWAFMYYVSMYRYPLDLLLINEYGGSARGRCVAWMAGKNDAMPGGVCLRTGADVLRDRGIDEGMRWVNVGVMLGFFLLYRILCWAVLVRRASKTTL

SEQ ID NO: 96309 - DNA, 2237 bp, Zea mays
  misc_feature: Ceres CLONE 1598893
  misc_feature: Encodes the peptide sequence at SEQ ID NO. 96310
agcttgcttgtcgtctccatccgtgcatcgtcttcctcctctacctcctctcttctccttcggctgggtttgggttaacaaaggcagagggaccagcggcagcgaaggtcaattgcatcgcatcggatcagatctcgactcaattcccgcggttaatccacatatcgactcaattcccgcggttaatccaccgccaacacctaagttaaaaccacggcggcggaggcatcggccatgctggcgcgtgtggctgcggagatagccgcgctcccggagccgcgcgggcccatgcgccgcctctgcggggacctcgcgcgccgcatccgcctcctcgcgcccctactccagcacctccaagacagggacctggacgacgccttgcgtctcgcagacgcgctcggggccgcgcgcgacctcctccgcgcagttcacgacggcagcaagatctaccaggccatgcaaggggatgccgtgctccaacgctttgcaactgtcaacagccacattcacttggccttggatgccttgccgtacaagaccttcgacttgcctgaagaagtgctggagcaggtcgatcttgtgcattctcagttcaaaagggctgcaaccacagctgctccaccagatgcacagctgtcaaaggacatatgctttgctcttgctgacaaggcctttgaccctcgggtcctcacgaggatctctgataagctgcaactgcacagcatggccgatatcaagaaagaatccctcgccctgcatgagatggtcatctccagcggcggcgaacctgatgcctgcgtcgacgagatgtcctccttgctcaagaagcttaaagactgcgtcgtcactgaagcccccaccacagagacgcccaacgcccagtctacctccataaagcatacatctcctatcatccctgatgaattcagatgcccgatatccctcgagctcatgcaagaccctgtcatcgtttccagcgggcagacatacgagcgatctggcatccagaaatggcttgattctggacacaagacatgccctaagacgcagcagctcctctcccatacatcactgacaccaaactttgtcctaaaaagcttaatagctcagtggtgtgaggccaacggcattgagcttcctaagaacaaggcaaactcgcgagataagaaagcagcaaaaagctctgactatgaccatgctggtttagtatccctaatgaacaggctgaggagtgggagccaagatgagcaacgtgcagctgctggtgagatccgtttgcttgcaaagagaaatgtcaacaaccggatatgcattgctgatgcaggagctatccccttgctagtcaatctgctttcctctacagatccaagaacgcaggaacatgctgtcacagcgctccttaacctctccatccatgagaacaacaaggcaagcattgtaagctctcatgctatccctaagattgtggaagtgctcaaaactgggagcatggaggctagagagaatgcagcagccacactgtttagcttgtcagttgtagatgaaaacaaggttacaattggtggcgctggtgcaatacctccactcattaatctcctgtgcgatgggagcccaagaggcaagaaagatgctgcaacggcaatttttaatctgtgcatataccagggaaataagattcgagcagtgaaagctggaatcgtcatccatctgatgaacttcttggtggatcctactggcggaatgatcgatgaggcactcactcttttggctattcttgcgggtaaccctgaagccaaggctgtaatttcgcaatcggatcccatcccaccacttgtcgaggtcattaaaactgggtctcctcgcaacagagagaatgctgcagccattctatggtcactttgttgcactgatattgaccaaacgagggctgcaaaagctgctggagcggaggatgcactcaaggaactgtcagattctggcacagaacgtgcaaagagaaaagcttctagcattctggaactcatgcggcaagctgaagaagcatgaagctgaccgtagtagatttgcgaggttgtggttttgttatattgtactcttagacactaaatgtttctggatagtgtgtatttgagatatctgtaggcagatgcgttaagaattttctgtaaacatataaattggatgtataataatgaaagtcagcccaaactttgtatgtgaaaaaaaaaaaaaaaaaa

SEQ ID NO: 96310 - protein, 603 aa, Zea mays
  misc_feature: Ceres CLONE 1598893
  misc_feature (353)..(393): Pfam Name: Arm Pfam Description: Armadillo/beta-catenin-like repeat
  misc_feature (435)..(475): Pfam Name: Arm Pfam Description: Armadillo/beta-catenin-like repeat
  misc_feature (394)..(434): Pfam Name: Arm Pfam Description: Armadillo/beta-catenin-like repeat
  misc_feature (517)..(557): Pfam Name: Arm Pfam Description: Armadillo/beta-catenin-like repeat
  misc_feature (227)..(300): Pfam Name: U-box Pfam Description: U-box domain
MLARVAAEIAALPEPRGPMRRLCGDLARRIRLLAPLLQHLQDRDLDDALRLADALGAARDLLRAVHDGSKIYQAMQGDAVLQRFATVNSHIHLALDALPYKTFDLPEEVLEQVDLVHSQFKRAATTAAPPDAQLSKDICFALADKAFDPRVLTRISDKLQLHSMADIKKESLALHEMVISSGGEPDACVDEMSSLLKKLKDCVVTEAPTTETPNAQSTSIKHTSPIIPDEFRCPISLELMQDPVIVSSGQTYERSGIQKWLDSGHKTCPKTQQLLSHTSLTPNFVLKSLIAQWCEANGIELPKNKANSRDKKAAKSSDYDHAGLVSLMNRLRSGSQDEQRAAAGEIRLLAKRNVNNRICIADAGAIPLLVNLLSSTDPRTQEHAVTALLNLSIHENNKASIVSSHAIPKIVEVLKTGSMEARENAAATLFSLSVVDENKVTIGGAGAIPPLINLLCDGSPRGKKDAATAIFNLCIYQGNKIRAVKAGIVIHLMNFLVDPTGGMIDEALTLLAILAGNPEAKAVISQSDPIPPLVEVIKTGSPRNRENAAAILWSLCCTDIDQTRAAKAAGAEDALKELSDSGTERAKRKASSILELMRQAEEA

SEQ ID NO: 96311 - DNA, 2672 bp, Zea mays
  misc_feature: Ceres CLONE 1598930
  misc_feature: Encodes the peptide sequence at SEQ ID NO. 96312
aacagggagtcagagatactgatcggaggcggtgtcttctacttctagccgcaaccgcaggccgcacgcagccccaccgctccgcccgtccatcctctccaactagtggcagcgcggtggcaaccgctcacccaccactcctcccccaaatttccccacaatcatagctctgcacgttagggagcgacgccgacgcaccaaaggaacgaggggaggccagggaacagcagatacgcaagcgccgcaatgctgggctccaagacgaaatctggctccgccgaggcgaagagcaacggcaaaccggacaaggagaagaagggcggcggaggcggcacgccgccaacccccaaggacagcaagccgcgcaagccggccgtgcccaaggcgagcgccgccggccatggcacgccgcgcactgctgacaagtcccccggctcggggtcggccgaccgcaaggcgccaacgcccaaggccaccgcctctcgcctcgctacgactccagagaaggggaagcccgcgaagccgccgcaggagcagcaggcgcagcttgccgcgatccgagaagagctcgtgaaggccaaggagcagttggtggagaacgagaaggagaggtgcaaagttcttgctgagctggagcgtgccaagaaggtggctgatgaggccaatgccaagctgcaggatgcgcttgatgtgcaaaagagggctattgaggcgcaggaggcagacaaactccctgccagagagtcggagcaggcaagcatccatggccgccagcaggaggctgatgacgccgtgctgcggtcgacagtggagcagctggagaaggccaggtatgagctggccgacgcaatcgatgccaagaatgaagccctcagccaggtagatgatgccgttagggcttctgaggtaaaggccctggaagttgagcatctcactgcagaggttacacgcctcaaagggctgcttgattccaaggtggatggcaacaggaagaagactgcagagaggattcagaatcttgaagaagagaactttgcattaaagcttgagcttgagaaaaaaaatgctgctgaagaaaaggcagttcgattggagcgcatgattgatgagcttaagtgtgatgttgatgatgctaggaattttggttccaagtcaaagcagttagctgatgcatggcagaagaaggcacagcttcttgaggtcagattggaagaggctgatcagtctaatattttgaagggcgaatctttgaattcagcaatggaagaattggattcaacaagtagtttgcttcgtgacagagaatctgaagttgctgctcttcgtgacaaagtcaggttcttggaggatgagctgacaaagctcaagagtgatattgttgtgtccggccaacgggcagatgcagcagagaaagagacggcggatctatggacagaggttgaagggcttaggctaaagctccatacagtggaagaagagaaaatggaggccctgaacagtgataagaatactagctcagaaattgagaccttgaatgaacagaagaaccagctggctgacgagcttgaggctagcaaagatgagcttgagaaaattaagaaggcaatggagggtctggcctcagccttacaggaaatgtcagctgaatccagagaggcgcaagaaaagtaccttctgaaacaagatgagatagagcgtgctcaggcacagttagaggagcttaacttgagtctgaagaatattaaggagaactatgagctactgcttgatgaggcaaactatgagaaggtttgccttacgaaagcagttgaaagactggaagcagaagctaagagagcgcatgaggaatggcagtccaaagagctaagttttgtcagctctattaagaattcagaagaagagatagtcgctgtcagggttcaaatggacaggaccttggaggttgttaaggagaaagaaaatgaaaacacagagttgcaggagaagctgcagcagcttgaatctcagctaatggaagcgaacagaatcagagaggaaggcaacactgaaactatccgatggaaggagaacatattagaccaagagaatgaattacagaacataaaacaggagaacgacgacctgcagacaaaggaatcagcagcttctgagaagattaaggaactctcttcccagcttactaatgcaaaagatggcacgataaatagtaacaccaaggaaggagataatgagaaggggggcactgaagaggacgatgaacctgttgtagtagttgccaaaatgtgggagaacagcaagtttgctgactatgattcatcgaaggagaaggagaatgatggtgactcacaggttgatttggaatcaaacaagggggatgcaggtcttgacagcaatgggttgcacttaactaaggagaacagtggcagggcatcaccaactaaacagcaccagcagtataagaagaaggctctgctgaagagattcggtggtctgctaaaaaagaaaagcgaaaattagcataaaaccgtctgatgatattctttgttctatcatttgacatatttctttgattagatatctagttcccgagtcttcccccatattatggtaaactaagtgatggatgcttcaaagaatacaaaatgtcgactttattaaaaaaaaaaaaaaaa

SEQ ID NO: 96312 - protein, 756 aa, Zea mays
  misc_feature: Ceres CLONE 1598930
  misc_feature: SWISSPROT Homolog: EC 2.7.11.1 Non-specific serine/threonine protein kinase
MLGSKTKSGSAEAKSNGKPDKEKKGGGGGTPPTPKDSKPRKPAVPKASAAGHGTPRTADKSPGSGSADRKAPTPKATASRLATTPEKGKPAKPPQEQQAQLAAIREELVKAKEQLVENEKERCKVLAELERAKKVADEANAKLQDALDVQKRAIEAQEADKLPARESEQASIHGRQQEADDAVLRSTVEQLEKARYELADAIDAKNEALSQVDDAVRASEVKALEVEHLTAEVTRLKGLLDSKVDGNRKKTAERIQNLEEENFALKLELEKKNAAEEKAVRLERMIDELKCDVDDARNFGSKSKQLADAWQKKAQLLEVRLEEADQSNILKGESLNSAMEELDSTSSLLRDRESEVAALRDKVRFLEDELTKLKSDIVVSGQRADAAEKETADLWTEVEGLRLKLHTVEEEKMEALNSDKNTSSEIETLNEQKNQLADELEASKDELEKIKKAMEGLASALQEMSAESREAQEKYLLKQDEIERAQAQLEELNLSLKNIKENYELLLDEANYEKVCLTKAVERLEAEAKRAHEEWQSKELSFVSSIKNSEEEIVAVRVQMDRTLEVVKEKENENTELQEKLQQLESQLMEANRIREEGNTETIRWKENILDQENELQNIKQENDDLQTKESAASEKIKELSSQLTNAKDGTINSNTKEGDNEKGGTEEDDEPVVVVAKMWENSKFADYDSSKEKENDGDSQVDLESNKGDAGLDSNGLHLTKENSGRASPTKQHQQYKKKALLKRFGGLLKKKSEN

SEQ ID NO: 96313 - DNA, 2248 bp, Zea mays
  misc_feature: Ceres CLONE 1598983
  misc_feature: Encodes the peptide sequence at SEQ ID NO. 96314
agaccttccgcgcaatccgccgcttctatcgtcgccgacgacttcctccttcagtccttcccctgtcttccacagttccacttcctcttcctcctgcccggcgcgctcccacctcctctcacaagccacacccatggcgacgacggcccatccggcgctcctcttgctcatcgtcctagcatgtgccggcgccgccagcgggttctacctccccggcgtcgcccccgccgacttccgcaagaacgacttgctcgccgtgaaggtgaaccagctgagctccatcaagacgcagctgccatactcctactactccctccccttctgcaggccggacaccatcgtcaacagcgccgagaacctcggccaggtcctccgcggcgaccgaatcgagaactcaccctacgtgttcgagatgatggagcctaagctgtgtcagatcgcgtgcaaggttgttctgaccgagcagggagcaaaggacatcatggagaaaatccacgacgagtaccgtgtaaacatgattcttgacaacctccctatggtcgtcccgattgagagattggatagagacgcgcctccattctatcagcaaggtgtgcacgtgggtgtcaagggccactacgctgggagtaatgaattcaagtatttcatccacaaccactactcatttctcgtgaagtataacaaggatgcacaaacagatctcgctaggattgtggcctttgaggttaaaccgttcagtcttaaacatgaattcgatggtgattggaaggggaatgcaactcgacttaaaacctgtaatacacaatctgagcatctaatagtgaactctgatgggcctgaagaagtaaaggcaaacaaagagatcattttcacctatgatgttaactttgaggaaagcagtatccagtggtcatcccgctgggacacctacctccgcacgcctgacgatcattggttttccatcgtgaattctctgaccacggtcctcttcctgtctgtgatggttgccatgatcatgctccgaactctgtaccgcgatatttccaagtacaaccagctagaggaccaggaggaggcccaagaggagtctggatggaagcttctccatggcgatgtgttcaggcctcctgccaatgccgacctgctgtgcgtgtatgtgggcacaggtgtacagttctttgggatgctgctggtcaccttgctgattgccatcctggggctcctgtcaccttcaaaccgtggagggttcatgacagccatgatcctgctctgggtcttcatgggcctgcttgcagggtactccactgcacgtcttcacaagatgttcggggggctggaatgggataaggtcgccatcaagacggtcttggtattccctggagtcgtcttcgtgatattctttgccctgaacatgctcctctggggcgtgaaatcatctggggctgtgccattcaccaccatgttggcactggttttcctgtggctcggaatctcaatgccactcatctttgtcggcagctaccttgggtttaggaagcctgccatagagggcccagtgaggacaaacaagatcccacgcctgataccgcagcagccatggtatatgaacccagccgtctcggtgttggtcggaggtatcctaccctttggtgcagtgttcatggagctcttcttcatcctgacaacgatctggatgcaccagttctactacatcttcgggttcctgttcctcgtcttcgtgatcctgatagtgacctgcgccgagatcaccatcgtgctttgctatttccagctgtgcagtgaggactaccagtggtggtggaggtcctacctgacgcccggctcgtcggctctgtacctcttcctgtatgcagcattctatttcttcacgaaactgcagatcacgaaggcggtctccggcgtgctctacttcggctacatgctcatcgcggcttatgccttctttgtactcaccggcaccattggcttttatgcctgcttctggttcaccaggcttatatactcttcggtgaagattgactaggaagctagaatgccatcgtttcatggtcggcaagagaaatcagaggtcaaagttgtgaaagaatacatgaaaatgtagcatggtttgtgcacagaagtaaggtgtccatagggtatctattcgtctgataattcagatacacttttgcgttcagtaaaacttgagtatgtgcgcgcattattatcataaaaaaaaaaaaaaaaa

SEQ ID NO: 96314 - protein, 636 aa, Zea mays
  misc_feature: Ceres CLONE 1598983
  misc_feature (54)..(594): Pfam Name: EMP70 Pfam Description: Endomembrane protein 70
MATTAHPALLLLIVLACAGAASGFYLPGVAPADFRKNDLLAVKVNQLSSIKTQLPYSYYSLPFCRPDTIVNSAENLGQVLRGDRIENSPYVFEMMEPKLCQIACKVVLTEQGAKDIMEKIHDEYRVNMILDNLPMVVPIERLDRDAPPFYQQGVHVGVKGHYAGSNEFKYFIHNHYSFLVKYNKDAQTDLARIVAFEVKPFSLKHEFDGDWKGNATRLKTCNTQSEHLIVNSDGPEEVKANKEIIFTYDVNFEESSIQWSSRWDTYLRTPDDHWFSIVNSLTTVLFLSVMVAMIMLRTLYRDISKYNQLEDQEEAQEESGWKLLHGDVFRPPANADLLCVYVGTGVQFFGMLLVTLLIAILGLLSPSNRGGFMTAMILLWVFMGLLAGYSTARLHKMFGGLEWDKVAIKTVLVFPGVVFVIFFALNMLLWGVKSSGAVPFTTMLALVFLWLGISMPLIFVGSYLGFRKPAIEGPVRTNKIPRLIPQQPWYMNPAVSVLVGGILPFGAVFMELFFILTTIWMHQFYYIFGFLFLVFVILIVTCAEITIVLCYFQLCSEDYQWWWRSYLTPGSSALYLFLYAAFYFFTKLQITKAVSGVLYFGYMLIAAYAFFVLTGTIGFYACFWFTRLIYSSVKID

SEQ ID NO: 96315 - DNA, 1996 bp, Zea mays
  misc_feature: Ceres CLONE 1599221
  misc_feature: Encodes the peptide sequence at SEQ ID NO. 96316
aaagcgcgccccctccccgccccacaataaaacagccacacgctcgccacccatggccaccaccaccacagcacaggcccactgccaccgctaccgctaaccatggcctcctcagcgtccctgcagcggttcctcctgccctccccgcacgcggcggcgacggcggcctcgccgtcctcccggctgcgccgcacagggcgcgcccgcgcggccgtctccgtgcctccgccggcggcggcgggggagcaggtcccgacggagcggctggagccgagggtcgaggagcgggcgggcgggtactgggtcctcaaggagaagtaccgggcggggctgaacccgcaggagaaggtgaagctggagaaggagcccatggcgctgttcatggagggcggcatccaggacctggccagggtccccatggagcagatcgacgccgccaagctcaccaaggacgacgtcgacgtccgcctcaagtggctcggcctcttccaccgccgcaagcaccagtacgggcggttcatgatgcggctgaagctgcccaacggcgtgacgacgagcgagcagacgcggtacctggcgagcgtcatcgaggcgtacggcgccgacgggtgcgcggacgtgaccacccggcagaactggcagatccgcggggtgacgctcccggacgtcccggccatcctggacggcctccgcgccgtcggcctcaccagcctgcagagcggcatggacaacgtgcgcaaccccgtcggcaacccgctcgccggcgtcgacccccacgagatcgtcgacacgcgcccctacaccaaccttctctcctcctacgtcaccaacaactcccaggggaaccccacaatcaccaacctgccgaggaaatggaacgtctgcgtcatcggctcgcacgacctgtacgagcacccgcacatcaacgacctcgcgtacatgccggccgtcaaggacggcgagttcggcttcaaccttctggtgggcgggttcatcagccccaagaggtgggccgaggcgttgccgctcgacgcttgggtcgccggggacgacgtcgtccccgtctgcaaggccatcctcgaggcgtaccgggacctcggctccaggggcaaccggcagaagacgcgcatgatgtggctcatcgacgagctcgggatggaggtgttccggtcggaggtggagaagaggatgccgaacggggtgctggagcgcgccgcgccggaggatctcgtcgacaagcgctgggagcggcgggactacctcggcgtgcacccgcagaagcaggaaggcctgtcgtacgtgggcctccacgtgcccgtgggccggctgcaggccgcggacatgttcgagctggcgcgcctcgccgacgagtacggcaccggcgagctccggctcacggtggagcagaacatcgtgctccccaacgtcagcaacgagaggctcgacgcgctgctggcggagccgctgctgcaggagcagcggctctcgccgcggccgtccatgctgctcaggggcctggtggcgtgcacgggcaaccagttctgcgggcaggccatcatcgagaccaaggcgcgggcgctgcaggtggcgcgggaggtggagaagcgcgtggccgtgccgcggccggtccgcatgcactggaccggatgccccaacagctgcggccaggtgcaggtggcggacatcggcttcatgggctgccttaccaaggacagcgacggcaagatcgtcgaggccgcggacatcttcgtgggcggccgcgtcggcagcgactcgcacctggccgacgtctacaggaagtccgtgccgtgcaaggacctggtgcccatcgtggccgacctcctggtggagcggttcggggccgtgccaagggagagggaggaggatgaggagtaggaccttcgtcaagcgccggctgggactgtcctgacctattttatgaggtcttgattggatgtatatatatattcatcttaatcaaaaaaaaaaaaaaaaa

SEQ ID NO: 96316 - protein, 597 aa, Zea mays
  misc_feature: Ceres CLONE 1599221
  misc_feature (129)..(199): Pfam Name: NIR_SIR_ferr Pfam Description: Nitrite/Sulfite reductase ferredoxin-like half domain
  misc_feature (388)..(457): Pfam Name: NIR_SIR_ferr Pfam Description: Nitrite/Sulfite reductase ferredoxin-like half domain
  misc_feature (207)..(367): Pfam Name: NIR_SIR Pfam Description: Nitrite and sulphite reductase 4Fe-4S domain
  misc_feature (465)..(598): Pfam Name: NIR_SIR Pfam Description: Nitrite and sulphite reductase 4Fe-4S domain
  misc_feature: SWISSPROT Homolog: EC 1.7.7.1 Ferredoxin--nitrite reductase
MASSASLQRFLLPSPHAAATAASPSSRLRRTGRARAAVSVPPPAAAGEQVPTERLEPRVEERAGGYWVLKEKYRAGLNPQEKVKLEKEPMALFMEGGIQDLARVPMEQIDAAKLTKDDVDVRLKWLGLFHRRKHQYGRFMMRLKLPNGVTTSEQTRYLASVIEAYGADGCADVTTRQNWQIRGVTLPDVPAILDGLRAVGLTSLQSGMDNVRNPVGNPLAGVDPHEIVDTRPYTNLLSSYVTNNSQGNPTITNLPRKWNVCVIGSHDLYEHPHINDLAYMPAVKDGEFGFNLLVGGFISPKRWAEALPLDAWVAGDDVVPVCKAILEAYRDLGSRGNRQKTRMMWLIDELGMEVFRSEVEKRMPNGVLERAAPEDLVDKRWERRDYLGVHPQKQEGLSYVGLHVPVGRLQAADMFELARLADEYGTGELRLTVEQNIVLPNVSNERLDALLAEPLLQEQRLSPRPSMLLRGLVACTGNQFCGQAIIETKARALQVAREVEKRVAVPRPVRMHWTGCPNSCGQVQVADIGFMGCLTKDSDGKIVEAADIFVGGRVGSDSHLADVYRKSVPCKDLVPIVADLLVERFGAVPREREEDEE

SEQ ID NO: 96317 - DNA, 2321 bp, Zea mays
  misc_feature: Ceres CLONE 1599239
  misc_feature: Encodes the peptide sequence at SEQ ID NO. 96318
actctttggtttgttttcgtggtgggcgagcaaggcggctgaggggctctgatcggcgcgtcgggttggagctgtcgaccttgggagatttcgtgtcgctctggaagggatcaaatgcggcgcctacttacttggtggactggctggagagctctagtgtcagccagtgttcctgctgtcgcctgcctcatctaggtcccctcccttcgttcagctgttcttgcgagttgttaatctaccgtatctaggttttgaggagatggatgacgaggactactcgtgggtgcggcgcaccaggttctcgcagtctgtcgtcaggtccagctccggcagggagcggtatggcgcgttcatcgacccgttcggtcgtggcgccaagctgaggcaggacgggttgggcacgggccccggggtctctagctcggcaaggctgccgatccccaaggcgagaccggcagttgcccggtcggaacggaggctgaagcacgcgtcttcagagggccaattgaacagggtgaggaacggtgatcgctcgtcgcaaggatcaccggcgaagcagagccgggagggggtcggcctgagcttggacattccacagctgcatgatttggctgttcgaccatccaaggacaaggaggagagcccagacgctgcgctggatttctctttccactcggacgagcacagccagaggctccagcgagtgtgttccagcccggctcctttctttctgcaggatgcagcagcgacagctgatggtggttccagagtgcgcagtgcatctacgaaggtgtccaagccgccgccgccgaaaccgaagcgaagagccaagtcccctatccccaagcgcgtcatctcggacgtgttcaaggaggcgaaagctgccaccaagaggttctccagcccgcagcggcagaggaagcccatgtccccgcggtcgccagacgacagccctccactcggcttcgcctcgctaagagcaccgagcaagctgaagatcaacagcagagcatcctcatggccacgaacaaaccttgacagtggaccggcaagagttgctgcgctggagatccttgagaggtggacggtcgatcgctccgagttgctcatcggccatagatttgcatccggggcctataaccgattgttccacgggatctacaaggaccaacctgttgctgtgaagtttatcaggcagcccgacgatggcgaggacgacgaactgtctgctaagcttgagaagcagttcacttcagaggttacaattctggcaaggctccaacatcgtaatgtcattaagcttgttggggcctgtaattgcccgacggtcttctgtgtcatcaccgagtttctgtccggcggttctctgagggctttcttgcgaaagctggagcgtgaaactcttcctttggagaaggtcatttccatcgctctggatatcgcacgcggcctggaatatattcacctccaagggattgtgcaccgtgacatcaaacccgagaacatcttatttgatggagaattctgcgctaaagtcgtcgattttggagtggcgtgtgaagaaaaatactgcaatttgttaggcgatgatccaggtacttatagatggatggcaccagagatgtacaagcacaagccatatggccggaaggtcgatgtgtatagctttggacttgtcttgtgggaattggtcactggttcactcccttatcaagatatgactccgcttcaggcagcttttgcggttgttaataagaacttgaggccggctattccattgagctgcccagcagcgctgaagcttctgatcgagcaatgttggtcctggcaaccagaaaggaggcctgagttccagcaaatagtttcagtccttgaaaacctcaagacagttcttgaaagagaaggaacactcgacaagatcccaagctcgatctgccaggccctggaacccaatgaccagaacaagaagaaggctggcaactggatccagaggctgtcatacgctcaacctgctttctccggacctccacccccaaagttactctagttacacgtcttcttgttcttagcagcttggtatctggtactccagatagcaagtgtgtaaattgaatctttcttggtttcgctgggagaccagagatttcttcatggtatatactcggatacagtacatacatcatttttggggggagtgggagcacagtaaatacttgtttggctatcttaacaaattctatcttgatgatacattagactatgggagcgatatatatggcctgtttgattcggctttaaaaaaaaaaaaaaaaaaaaaaaaa

SEQ ID NO: 96318 - protein, 595 aa, Zea mays
  misc_feature: Ceres CLONE 1599239
  misc_feature (282)..(538): Pfam Name: Pkinase_Tyr Pfam Description: Protein tyrosine kinase
  misc_feature: SWISSPROT Homolog: EC 2.7.11.1 Non-specific serine/threonine protein kinase
MDDEDYSWVRRTRFSQSVVRSSSGRERYGAFIDPFGRGAKLRQDGLGTGPGVSSSARLPIPKARPAVARSERRLKHASSEGQLNRVRNGDRSSQGSPAKQSREGVGLSLDIPQLHDLAVRPSKDKEESPDAALDFSFHSDEHSQRLQRVCSSPAPFFLQDAAATADGGSRVRSASTKVSKPPPPKPKRRAKSPIPKRVISDVFKEAKAATKRFSSPQRQRKPMSPRSPDDSPPLGFASLRAPSKLKINSRASSWPRTNLDSGPARVAALEILERWTVDRSELLIGHRFASGAYNRLFHGIYKDQPVAVKFIRQPDDGEDDELSAKLEKQFTSEVTILARLQHRNVIKLVGACNCPTVFCVITEFLSGGSLRAFLRKLERETLPLEKVISIALDIARGLEYIHLQGIVHRDIKPENILFDGEFCAKVVDFGVACEEKYCNLLGDDPGTYRWMAPEMYKHKPYGRKVDVYSFGLVLWELVTGSLPYQDMTPLQAAFAVVNKNLRPAIPLSCPAALKLLIEQCWSWQPERRPEFQQIVSVLENLKTVLEREGTLDKIPSSICQALEPNDQNKKKAGNWIQRLSYAQPAFSGPPPPKLL

SEQ ID NO: 96319 - DNA, 2056 bp, Zea mays
  misc_feature: Ceres CLONE 1599579
  misc_feature: Encodes the peptide sequence at SEQ ID NO. 96320
agttttcccccaattccgcaacaccccgctactatatccattactgcctcagcctgtctctctcctccagcttggttccttcctctcgccgcttcgagagcgcgtagtcagcagcggcttgcgttcctgtcggtctcgcaggcgggagcagagcaggacgaggatgtcggatcagaaggatcctgggatcaagctcttcggccgggtgatcccgtgggggcctgaaaccgccccgggaaccacggaagtggaggacccgccgcaggatgagctgcagccacgggcgccggaggttgccgcggcggtggatgaggatgaacacaatgagaaggaagagaaaaatgctaatgaagtggttgtcatgccacaagagaagggtaaagaaaccaaggttgacacgccacaagaggagaagggtaatgaaatggaggttgacgcgccacaaaaggaacatgacgacgaaatgaaaattgacgcacaacgagaggaaaaagacgaacaaacggatgccaacgcatcaccaacgcatggaaatatagaaccagccaatctacctccctcaggcctgatggacagtgccgaagataaagcagcatcagatgcaaagggggagaacgagaagacatcaaatgaggaatcaggccaggacaaggcacttaataagaagccagataagatcctaccttgccctcggtgcaacagcatggatacaaagttctgctattacaacaactacaacgtgaatcaaccaaggcacttctgcaagaactgccagcggtactggactgcagggggcaccatgaggaacgtacctgttggtgccgggcggcgcaagagtaagaacgcgtcattgcactaccgtcaattactgatggcccctgactgtatgctggggcctagagtggacatatcaaagccagtgctccctgaagctcttgcatcatctccacctgccccgacacagccagccagtagaaatggaacggtcctaaaatttgggcctgaggtaccattttgcgagtcaatggtgtcggcgctgaacattgatgagcagaacgtgaacagccctggaggaccaacagcaagaggtgaaaacagggaagataataataaccctggatccggcacaccaccatacaacggtgtgcctgaaaccatggcccccgtcgtcggcaagaacggggcaccagttcattgtaacggggttgccccagtgcctcagtattaccttggaacccctttcatgtacccttggagtgtaggatggagcaacgtgcctgtgatggtgccaggtaaaagcatgcccgaacctgctcctgctccagagagctgcagtactagctcagctgtatggatgaaccctcccatgatgccgggctcaagacctcctagcccagcgtttccataccctctcgtgccacccgggctctggggctgtttttccggatggccacccacggcttggaacgtaccatggaccagaaccaacgtctccgtgtcgccgccgccatcgccatcaagcaacagcagcagctgctcgggcaacgggtctcctactctgggcaagcattccagggacaccaatccgctgagagaggagaaaagagagaagtcgctgtgggttcccaagacgctccggatcgatgaccctgatgacgccgccaagagttcgatatgggccaccctcggcatcaagcccggtgaccctggcactttcatcaagcctttccagtccaaggtcgagagcaagggccagaggtcggacgctgctcaggtcttgcaggcgaacccagcggcgttgtcgcgcttacagtcgttccaggagagctcttgacttcatacgcaaagtctgccttatatagttatatatagttttggtactgtaatccttacatgctggtagagttttgtggcatgtggaaagtgacttcatacctgcagcctatcttattgtttgtttcggtactgtattccttactgcatgctagtagagctgtgcggtatgtggaaaggtcaacagagagcttcttgtttagccacaaaaaaaaaaaaaaaa

SEQ ID NO: 96320 - protein, 556 aa, Zea mays
  misc_feature: Ceres CLONE 1599579
  misc_feature (168)..(230): Pfam Name: zf-Dof Pfam Description: Dof domain, zinc finger
MSDQKDPGIKLFGRVIPWGPETAPGTTEVEDPPQDELQPRAPEVAAAVDEDEHNEKEEKNANEVVVMPQEKGKETKVDTPQEEKGNEMEVDAPQKEHDDEMKIDAQREEKDEQTDANASPTHGNIEPANLPPSGLMDSAEDKAASDAKGENEKTSNEESGQDKALNKKPDKILPCPRCNSMDTKFCYYNNYNVNQPRHFCKNCQRYWTAGGTMRNVPVGAGRRKSKNASLHYRQLLMAPDCMLGPRVDISKPVLPEALASSPPAPTQPASRNGTVLKFGPEVPFCESMVSALNIDEQNVNSPGGPTARGENREDNNNPGSGTPPYNGVPETMAPVVGKNGAPVHCNGVAPVPQYYLGTPFMYPWSVGWSNVPVMVPGKSMPEPAPAPESCSTSSAVWMNPPMMPGSRPPSPAFPYPLVPPGLWGCFSGWPPTAWNVPWTRTNVSVSPPPSPSSNSSSCSGNGSPTLGKHSRDTNPLREEKREKSLWVPKTLRIDDPDDAAKSSIWATLGIKPGDPGTFIKPFQSKVESKGQRSDAAQVLQANPAALSRLQSFQESS

SEQ ID NO: 96321 - DNA, 2074 bp, Zea mays
  misc_feature: Ceres CLONE 1600520
  misc_feature: Encodes the peptide sequence at SEQ ID NO. 96322
agcgctaccaattggcacctcctgctgccgcgccaccatgctctatgctcacctccaccttcgccgcccctgctccccgttcgcctactgcccctacagcaagctatccgtttccatcccaaccctcaaccctctgccacgcgggccgctttctcgccgcgcctgcgcctgcgcccaccggtacctacgacacgtcgcgtcaccggcggatgaggaagaggctgggtacggggagggcagcgtggagggtgatgatctgggacccgcgtcagcggcggcagtggcagcgaccatccgccgggcctccagcgcgtcgcccgtgcggttcaggtgcgtgcttggagaggcagtggaggaaccgcgcggcgaggagggcttggccgacccaagccccgactttcgccggctctgtgcggagcagcttgagattttccgagtgctcatctcccgtgacgccgtactctctgtgtacgtgagacctgctggcagttatattatggatcagctggaactgcgccgagttgctttatatcctggaattaataatctttctgaaaaagatacccctgtcctagtttgtaatttttctatatcttctggactacgagcagcagaagcttttctagtaaaacaacagatggaagtcataagagaatttggggctatagttcttccaatggtgaaacacccctttgttgttgggttccttgtcgtagagcttccagaattacatggtggacgtgctatgaactcttatactgctgatactgagttaccacctaacacatttatggataaatcatctgatgtaactccacatactgcgtgggatattcaaacttatggtgatcaggcaaagggttattctcagcttgttaatgaatggaagaatagtgcccttatgatttctcgaactctggcaatggcttatgttatggatcagaaagcatatctgcttcaacaaacttcctggcaaaataatgttagaatgagtggcttagtggaacagatttggggccccctctctagcattcgtgctcttgcaaagatgttatcctttcacacaaagagaagtgagatcccctatgatattattgaagatatgctcacccaaggtgatcacatgaaagatgctctgcaacaaattcaagatgctgtatatctgactaaggcaaacatagttagaagcaatgaggagactttaaagacaattcagagatcaccacatccttcaagaactttatcagattataaatcagtacctgggaatgattcacagaagttggatccagttttagccctgagttctgatgggtatgacatggtgatgcctatgccacctctatggctggcacctcttcaacaccaatatgatagaccatgtgatctctgtgatgtgctgaaggatttagttgcaggagcattaccacttgcttataagcagcagcgcacattagatttaacagaaatttcacatccacttcatgttgctgttgaggaatctgctttaagaaaagccttgagtaatctgattgagggagcgctcctacgtacacagcatggtggagtagttcaaatatgtgcagtcgaagcacctgcaggaggcgctctcgtggtcatcgatgatgatgggcctgatatgcaatacatgactcagatgcgctccctggccccatttggatcagaccttgcagatggtatgctcgaagataacatgacgtggaacttcatcgcgggattaacggtcgcacgtgagctacttgaggaatatggatgcgtcctgcgtgtgatatcacctcgaaggactgatgcggttataggcaccggagggagtcgtgttgagatatggttgccatcttttcagacacaagcagccaagactagtcaagaagtgtagtttacatctgaggaagcgaggcatgcttcgttttcccgtacgttttgaaatctgtagatattggcttaccggaatgttactgtaccagtaacatctcatatgttgaatttgcaaaattacaggacgtgcgcaaatgattgtgatggtgatgttgcattgcaaaaaaaaaaaaaaaaa

SEQ ID NO: 96322 - protein, 619 aa, Zea mays
  misc_feature: Ceres CLONE 1600520
MLYAHLHLRRPCSPFAYCPYSKLSVSIPTLNPLPRGPLSRRACACAHRYLRHVASPADEEEAGYGEGSVEGDDLGPASAAAVAATIRRASSASPVRFRCVLGEAVEEPRGEEGLADPSPDFRRLCAEQLEIFRVLISRDAVLSVYVRPAGSYIMDQLELRRVALYPGINNLSEKDTPVLVCNFSISSGLRAAEAFLVKQQMEVIREFGAIVLPMVKHPFVVGFLVVELPELHGGRAMNSYTADTELPPNTFMDKSSDVTPHTAWDIQTYGDQAKGYSQLVNEWKNSALMISRTLAMAYVMDQKAYLLQQTSWQNNVRMSGLVEQIWGPLSSIRALAKMLSFHTKRSEIPYDIIEDMLTQGDHMKDALQQIQDAVYLTKANIVRSNEETLKTIQRSPHPSRTLSDYKSVPGNDSQKLDPVLALSSDGYDMVMPMPPLWLAPLQHQYDRPCDLCDVLKDLVAGALPLAYKQQRTLDLTEISHPLHVAVEESALRKALSNLIEGALLRTQHGGVVQICAVEAPAGGALVVIDDDGPDMQYMTQMRSLAPFGSDLADGMLEDNMTWNFIAGLTVARELLEEYGCVLRVISPRRTDAVIGTGGSRVEIWLPSFQTQAAKTSQEV

SEQ ID NO: 96323 - DNA, 1917 bp, Zea mays
  misc_feature: Ceres CLONE 1600747
  misc_feature: Encodes the peptide sequence at SEQ ID NO. 96324
agccagaaaaaggcagcctcctcccccaacccaagtctctctctctctcccaaaccaaaagaaggcttccacttccagctgcagcggagcatcgccagttcagagttcaccaccacgcctttgacctccagcccatagcccaatcccgcaagcatccatccacgcccaccgcacccgctataaaatctccccctctgctcccgattcgccacctaaaggaggcgcctttccccaaatccaccaccaccgagaaacaaccgcaggaaatccgctcggccctcggctccggtcactctgttgcggccacgatgaaagagggcagacccggcgccggcgactacattgccagcctgctaagctcgtcgccgaggctcgacttcggcggggaggaggaggaggactgcctggacaggttctgcggcgacccggggttcgcggctcgcgcagcgcggctgtccagcttcagcgggcagcgcttcgccgtcaccgcgggcctcttcgggctgcccccgccgctgtccgccgcgagcggcggcggcggcgagttcgccgggtcccgggaggcatcgtcggtgtcggacccggcgtcggcgatgaaggacgccaatgccaagaagcggaaggcgcccgcggcggcggccaagggcaaaggcagggagccatctgcgcaggcgcaggcaggggagccgaagggtccggacgccaagaggtgctgcaaggcggagggaggcgagggggtggaggggagccccgtgaagctgcccaagccggagcaggccggcagcgacagctccgtcgaggacggcggcggcgcgcagaaccagaagccgccgccggggaaggggaagaatgccaagccggtggagcctcccagggactacgtccatgtccgggccaggagagggcaggctaccgacagccacagcctcgcagagagggtgagaagggagaggatcagccagaggatgaaggtccttcaggacctggtgccaggatgcaacaaggtgatcggcaaggcgctgatgctcgacgagatcataaactacgtgcagtcgctgcaacggcaggtcgagttcctctccatgaagctcgcaaccgtcaacccactggacctgagcaacctgcccacgctcctacaaaaagatatgttccaggcctgcggcgcttcggcgagctcggtcttctcgctggagagctgcagcccggggttcccgttcggcgggcaaggggacgtgttccagtccttcgccccgaacggcctggagaacccgtgcggcggcctgaacccgctggacctggctctgtcccatgctaccggcgggcagttcggtttccaggacggaacggccggcacaaacctgcagcaaagaaactactgggaggaggaggaggacctgcagagcgtgttccacatcgacgacaacgggcagagccaggagcacggggcctcagcttcagcacaaagcttccatggtcagctacaatcacaagagggccacatgaagatggagttcttctgatcggcgtcgacacccagccgccgccggccgagggagcgacctgtacatagcgaagactcgaggtacaatacaaccgcaccagcggcggcggcggcggccggcggggaccgaagctctgaagctatagctaacagcagcaagtccgtacgtgtaggcccccttgcccttggagaggcgagttcttcgctcgccgtagcgtgaaccactgggggggggggggggggggggcgatcgtgtgatttctttgaacgttttcgatcggcgattaatttgattgattaacacagccaccccgacgatagcgtacgtaccaatcacccgaacagtgaagctgtcacttttgtgtataagataatgcatatggtgcagatattagtatcaaaaaaaaaaaaaaaaa

SEQ ID NO: 96324 - protein, 403 aa, Zea mays
  misc_feature: Ceres CLONE 1600747
  misc_feature (201)..(251): Pfam Name: HLH Pfam Description: Helix-loop-helix DNA-binding domain
MKEGRPGAGDYIASLLSSSPRLDFGGEEEEDCLDRFCGDPGFAARAARLSSFSGQRFAVTAGLFGLPPPLSAASGGGGEFAGSREASSVSDPASAMKDANAKKRKAPAAAAKGKGREPSAQAQAGEPKGPDAKRCCKAEGGEGVEGSPVKLPKPEQAGSDSSVEDGGGAQNQKPPPGKGKNAKPVEPPRDYVHVRARRGQATDSHSLAERVRRERISQRMKVLQDLVPGCNKVIGKALMLDEIINYVQSLQRQVEFLSMKLATVNPLDLSNLPTLLQKDMFQACGASASSVFSLESCSPGFPFGGQGDVFQSFAPNGLENPCGGLNPLDLALSHATGGQFGFQDGTAGTNLQQRNYWEEEEDLQSVFHIDDNGQSQEHGASASAQSFHGQLQSQEGHMKMEFF

SEQ ID NO: 96325 - DNA, 868 bp, Zea mays
  misc_feature: Ceres CLONE 1600788
  misc_feature: Encodes the peptide sequence at SEQ ID NO. 96326
aatgggtcgccctcctcgcgacgcagtgcgaccacgccgccaccttcgcctgggaaccgcgaccgctccatgaagaggggatcagatttgctcatcgcgacctaccttgggggttcattttgtgttgttgggttggatggggagaagtgtcgagcacatggtgcttgcagtttggtttgttcgtgttgacaatttctctgtggggcgttgcagggaagatgggggtcgaggagaggcaggcgcagaagagctcctaggaggagcatcccaaggacctcatcgtcgatgccatgatgctggactcacgcgctgtcaatctcgacaaggggccacctgtcgctctggacaagggggctgccctaagaatgaaagcattaaggtatgcagttggatattgcattcagagaggctcaagcgatagctgcaagtagttctaccttgtgcccagttttcttgttcttttagaaaattcttctgctacctatacctgaatgttactgatagcttacactaatggaagtcaaaatatcgtgggacatccagctgagcgagaagatagtgttgcatcaagttcagttttttttgtcatcaagttgtaggctgtgtggtacatccagctgggtgagaagacaatactgcaccaagcgagaagatagtcctgcaacaactcgtgccatcggcttcctcgacggcgaacgctcgtgaccgtaggaaccatattgtagaaacatttgcgtggttgaacaatagatttcaaagtgttttatgaaaattatagagagctattggagcattgtcttttttggatttattatttttaaagagatcccaatacccttgttttggaagccaaaaaaaaaaaaaaaaa

SEQ ID NO: 96326 - protein, 94 aa, Zea mays
  misc_feature: Ceres CLONE 1600788
MGRSVEHMVLAVWFVRVDNFSVGRCREDGGRGEAGAEELLGGASQGPHRRCHDAGLTRCQSRQGATCRSGQGGCPKNESIKVCSWILHSERLKR

SEQ ID NO: 96327 - DNA, 2304 bp, Zea mays
  misc_feature: Ceres CLONE 1600884
  misc_feature: Encodes the peptide sequence at SEQ ID NO. 96328
aacacagcgcagcggcgcagagcttcacgctctcccacgcagccctcctccagacctccaccactaccgctaccagcggcagcagcgtcgccccctccgcctctccgcttccttctagccctctcatcggcatctctagcgcggcgcatctgtagcggaggaggaagagcggagcgtcgtctcgccccgcccgcggcattggctgcgggaactgggaaaggaggaattgaatagatacaagcttcgggaacctgcctgatccggatccgaatccgcgctgccgaccggcggagtttgggggcaacatagcttgctcgagagatggaggacctgttgggttcggagatcgggaagaacgactacgattggcttctaactcctcctgggaccccacgtgttcctgcactggagtttgctgaggaaacaccatcctcaaatatattactgaagcgcactgcaactagatcgtcctcaactactagagcatctaggcttccagtatctcaaacagagaatgggcattcgatggttcccactagaccaacaagaagtaacagccgaccatctatccaatcggctctcatgaatggcaacaacaggacatcagttccgaacacaagcatttcttcagtgacttcaagacctacaacccctagtaggcgaagcagcacagttgtcgcaccaaaacaatcagttccagctgcacgtacagtgcctgcaagatcctctacacctgttaaaactcgtctatctacaccagcaaaaacccgcccatctactcctacaagtactcgcccaacagcaccaaactcttcaactgattcgtctgctgccaagaccacatccacacataatgtgaggccatcgactccaaattcccgaccccgtattgttcccaattcatcttcaggtgcagctcatacaataagccgcccgagcgcctcctcgagtacaacaagcagatcagggtcttcctcaggtaatgttcctgggataagccgtgccacctcgttgtcctcaagttcgattccttccatgagccattccagctcacgatcatctacacctacacgccaacctgcaattcgttcatcggctccagctattggtcgttctccttctgttggacggagttctagcatcaacagctttacatctgtgtcccagtctgcagccagtagtggtcggaactcagcaccttcatcagctccatcatctcgtccaagttctccgaatccacgaccccgagctccagtgcgaccacttaatatccctgatttcccaaatgaagctccaccaaatctaaggacaaaattacctgaaagaccactatctgctggcagatcacggcctggaatggctttaggcataagatcaaccccaaatactgaaccttcagccgcctcagctcctatgaagaaggtctctgtgtctgctgttagtcgaagtaaattttctgatgcatcatcaaagacctctactcccacaaatgggcaccaaaatcgacaggctgaaaggtccactgttgacagccaagctaatagaccctcaagacctgtcacaggcacagataatggatttgggaggtcgatatcaaagaggtcacttgacatggctatcaggcacatggacattcggcagaacttgggtggcattcgaggcgcatccctgtttccccagagcacccgctcggctgctgccaaggtccgtccagctcggacatcagacccagggcatggcatctcaaaaggcgaccagcaccgcactgacaatggaaacagcttgaacgggcacctctatgtctctggggactcgaacggagctctctcacgcaatggtggcagctcaaccggttcgccagacagggagagcatcaggaccaaggagaccctgatcgagctggacatctatggtagctcgcgctatgaagcaatgctgctgagcgaggacttgcggaacacaagctggctgcatggattcgacgacaagcccgaccaaagcccgctgtttgaccaccggttcgagccgctgccggagcccttcagcccgttatgacagccgctgcttgtaaagtacagtatgatcaccactagctagctcttcgttctgtgctccttttgtgctgcaaaatgtgtatgatttggtctgttttatgtcttataaattatacgtgattggttggttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 96328 - protein, 577 aa, Zea mays
  misc_feature: Ceres CLONE 1600884
MEDLLGSEIGKNDYDWLLTPPGTPRVPALEFAEETPSSNILLKRTATRSSSTTRASRLPVSQTENGHSMVPTRPTRSNSRPSIQSALMNGNNRTSVPNTSISSVTSRPTTPSRRSSTVVAPKQSVPAARTVPARSSTPVKTRLSTPAKTRPSTPTSTRPTAPNSSTDSSAAKTTSTHNVRPSTPNSRPRIVPNSSSGAAHTISRPSASSSTTSRSGSSSGNVPGISRATSLSSSSIPSMSHSSSRSSTPTRQPAIRSSAPAIGRSPSVGRSSSINSFTSVSQSAASSGRNSAPSSAPSSRPSSPNPRPRAPVRPLNIPDFPNEAPPNLRTKLPERPLSAGRSRPGMALGIRSTPNTEPSAASAPMKKVSVSAVSRSKFSDASSKTSTPTNGHQNRQAERSTVDSQANRPSRPVTGTDNGFGRSISKRSLDMAIRHMDIRQNLGGIRGASLFPQSTRSAAAKVRPARTSDPGHGISKGDQHRTDNGNSLNGHLYVSGDSNGALSRNGGSSTGSPDRESIRTKETLIELDIYGSSRYEAMLLSEDLRNTSWLHGFDDKPDQSPLFDHRFEPLPEPFSPL

SEQ ID NO: 96329 - DNA, 2373 bp, Zea mays
  misc_feature: Ceres CLONE 1601085
  misc_feature: Encodes the peptide sequence at SEQ ID NO. 96330
agtcccatcttgtagctgcagcggcaccccctcaacatcgtccaaccaatcccaccagctgctcatctcgaatccagcccgaaacctcgcgccacgcgtgccgtcgacccagttcgtgcgcgttcagctgctgccccgcgctcagggatcgggaaggcaagctctttggtggttcctaagggcgaatctcgtggcgattcgctcagatttggatttagggtttaggaggcggtgctggtgatcggtttgtgccgccgggagagatgtcggcggctgtggcgtgcgcggagagggcgaccaacgacatgctgatcggcccggattgggcggtcaacatcgagctctgtgacatcatcaacatggatcccggacaagcaaaggatacactcaaactcctaaagaaacgtcttgcaagcaagaattcgaaagtgcaaattctaacactttatgtgctagagactctaagcaaaaattgtggggatatcgttcatcaacagattgttgagcgcgacatattgagtgaaatggttaagatagtaaagaaaaagccagacttgagcgtccgagagaagatattgagtttgattgacacatggcaagtggcttttggaggtccatctggaaaatatcgacagtatcatgcggcttaccaagaactcagggctgctggtgttgattttccgcctcgtgaggaaaattcagtcccgttgtttacaccacctcaaactcaaccgttaaggcatccacatctatatacacctccaggtcaaagctatgaagatgctgctatacaagcttctcttcagtctgcccctcctgcacctgccctcagtctgagtgagattcaaagcgctcgagggattgtggatgtgttagacgaaatgttaaatgctctggaccaccggcatcctgagggtgtaagggaggaggtcattgttgaccttgttggccagtgccgatcctatcaatcccgtgtcatggatcttgttaacagtactggcgacgagagccttttatttcaggctctagggctaaatgatgagttacagcgtgttgttcagcgtcatgatgacatagcaaaggggatccctcctggtactggagcacctttacctgcttctggaaatgtcaaccaagggactgccccacctaggcccactgcggtttcattttctccacttctaaatgtacatgaggacgatgaaccagaagacgagttctctgtgctttcccgcaggtctgcgagggatggtgcagtagcacagaacaatctgccttctgctccaagaaatgagaagccatacccaagcccacttcttcctccaccaccagcatctaagaggcctgtttataccgaggcaagcagtgttgactatcttagtggtgactcctacaagtcagagaaggtttcagatgatttcatcaacccaactgctccagctaacatatccacatcatcccattcaaaggcagaagcacatccacctccgagttatggtggcaggccagacagagtatctgacgacttcataaacccaactgcacctagcttctcggcgccttctcgtcctacaaatgaggagccagcccgcccatccgtgaagcggcaagagagcctacctgacgacgacttcataaacccaactgctcttcctggtttctcgtcgtcttcagctactaaggagtctggcgaggaccttccaaaggctccatgggaagcacaagctggcgcaggttcactaccgccgcctccggcgaggtacggccagagacagcagtacttcgagcagaacgtgtattctggcgggagcaacgaaggcgggtacaatggactgatgacacagaccgaaggcctctcgctgaacccgcggagcagcgagaacgagaggagcgcggcacggccggcagcgtcccgccctgccaaacctgaggactcgctcttcaaggacctggtcgacttggcaaagaccaagccttcgtccccgtcgaaaccggccaacagccgcaggacccgctagaacgactcgtgcgatgcatggatggacattgggtcgttcggatattcatttcacaggttagcggcttttagatggtaccatgaaataaggccgtctggagactggttttcattgcatatttgcatttgcatgggaaattgttttggttgcgtttagagtcacagatgtcagagacgttgcttgctcataatcctgggtgtgtgatgtctagttagctgctcctaaatttctgtgtcgttggcttccaattttcttttttttcttctttcacttagctgtgtatatatatgttacccgattcgacagcaaatattcatagttgagtttgtgacttgaggaaaaaaaaaaaaaaaaa

SEQ ID NO: 96330 - protein, 584 aa, Zea mays
  misc_feature: Ceres CLONE 1601085
  misc_feature (2)..(136): Pfam Name: VHS Pfam Description: VHS domain
  misc_feature (184)..(281): Pfam Name: GAT Pfam Description: GAT domain
MSAAVACAERATNDMLIGPDWAVNIELCDIINMDPGQAKDTLKLLKKRLASKNSKVQILTLYVLETLSKNCGDIVHQQIVERDILSEMVKIVKKKPDLSVREKILSLIDTWQVAFGGPSGKYRQYHAAYQELRAAGVDFPPREENSVPLFTPPQTQPLRHPHLYTPPGQSYEDAAIQASLQSAPPAPALSLSEIQSARGIVDVLDEMLNALDHRHPEGVREEVIVDLVGQCRSYQSRVMDLVNSTGDESLLFQALGLNDELQRVVQRHDDIAKGIPPGTGAPLPASGNVNQGTAPPRPTAVSFSPLLNVHEDDEPEDEFSVLSRRSARDGAVAQNNLPSAPRNEKPYPSPLLPPPPASKRPVYTEASSVDYLSGDSYKSEKVSDDFINPTAPANISTSSHSKAEAHPPPSYGGRPDRVSDDFINPTAPSFSAPSRPTNEEPARPSVKRQESLPDDDFINPTALPGFSSSSATKESGEDLPKAPWEAQAGAGSLPPPPARYGQRQQYFEQNVYSGGSNEGGYNGLMTQTEGLSLNPRSSENERSAARPAASRPAKPEDSLFKDLVDLAKTKPSSPSKPANSRRTR

SEQ ID NO: 96331 - DNA, 1959 bp, Zea mays
  misc_feature: Ceres CLONE 1601265
  misc_feature: Encodes the peptide sequence at SEQ ID NO. 96332
agctctgaccttccctccctccctccctccctcttggaccgagcgttcttctcttgcttttgccaaccagaagcctcgagccgacgcatccaagcatctcctccccctctaacctcccctcctcccaacaccatcagcgagcggtgccgactgcctcgcaaggccagcagcgcctcgcaagcgagcccaccgccgctgatcaccaggcctggttgttgaggcgaccctcgcgtgggactgcgacagcgccacagcggcgatggcggggctgccgccggtcgccaggcggctccggctccggctcgcgaccgcggcgctcctcctcgtcctgctgctcgcggtgaccgcggcggtggcggcgcgcgaggggcggggcctggcgcgggtgcagggcccgccgccgcggcaccgccacgcgtacgccgcgatgatgtacatgggcacgccgcgggactacgagttctacgtcgccgtgcgcgtcatgatgcgctcgctcacccgggtccgcgccgacgccgaccgcgtcctcatcgcctccgccgacgtgccgcgcgactgggtccgcgcaatgacagaagaggatggcatgagggtggtgatagtggagaacctcaggaatccttatgagggcaacctaggagggaccaacaagaggttcaagttgacactgaacaagctttatgcgtggaccctggtggactatgggcgtgtcgtcatgattgattctgataacatcttcctccagaacacagacgagctattccagtgtggacagttctgtgctgtgttcatcaacccgtgctacttccacactggtcttttcgtgctccagccttctattgatgtattcaagggcatgcttcatgacctggagaccggccgtgaaaactctgatggtgctgaccagggctttttggttgggtgctacccagacttgctcgataaaccaatgtttcaccctcctgagaatggcacaaagctcaatgggacctatcgccttcctctcggctatcaaatggatgcatcctactactatctcaagctacattggcatgtcccgtgtgggccaaacagtgttatcacattccccagcgcaccttggtttaaaccttggtactggtggtcatggccggtcttgccactaggactttcctggcacaagcagcgctgggacgatcttgggtatgcttctgaaatgccagtgatcctgatggaggttttaatgtacatagttatcataacggtcaccagactggcaaggccagggatgaccaaactgtgctacaaccggcggcctgagaagcaaagtgccctggtgcagtggctgatcaagctaactgcaattgtggctatggtggctgcgtactccattccattctttgtgatcccacgcacagttcacccgatcatgggctggtccgtctacctgtttggcgcgctcgcgttgtcggtgctcgttatcaacgtttttctgctcccgccacttgacgtgcttacaacgtggctcgcaattgtggggatgctcttcgttatggcgttcccatggtaccatgatggtgttgtgagggctctcgcagtctttggatacgcattttgctctgcgccattcttgtgggcatccgtggtgaggatgatggactcactgcagaccatgctcgagagggatccgttcttctcccggattggtgaaccaacacaggagactgaattcagcaagctgtactgattcttttgtgcacagattagagatgcttcgtcaccatatgaacagctggttcggaccagttagttttcgattgattctggtggttttcgctcaggcattccattgtgtgctcgggtagtaatgtataaacattgcctgcggcagccatgattgatgcagatacaggaaagataggccagttgtactgaactgaaaaaaaggaagcatatttgctacaaaaaaaaaaaaaaaaa

SEQ ID NO: 96332 - protein, 488 aa, Zea mays
  misc_feature: Ceres CLONE 1601265
  misc_feature (65)..(289): Pfam Name: Glyco_transf_8 Pfam Description: Glycosyl transferase family 8
  misc_feature: SWISSPROT Homolog: EC 2.4.1.186 Glycogenin glucosyltransferase
MAGLPPVARRLRLRLATAALLLVLLLAVTAAVAAREGRGLARVQGPPPRHRHAYAAMMYMGTPRDYEFYVAVRVMMRSLTRVRADADRVLIASADVPRDWVRAMTEEDGMRVVIVENLRNPYEGNLGGTNKRFKLTLNKLYAWTLVDYGRVVMIDSDNIFLQNTDELFQCGQFCAVFINPCYFHTGLFVLQPSIDVFKGMLHDLETGRENSDGADQGFLVGCYPDLLDKPMFHPPENGTKLNGTYRLPLGYQMDASYYYLKLHWHVPCGPNSVITFPSAPWFKPWYWWSWPVLPLGLSWHKQRWDDLGYASEMPVILMEVLMYIVIITVTRLARPGMTKLCYNRRPEKQSALVQWLIKLTAIVAMVAAYSIPFFVIPRTVHPIMGWSVYLFGALALSVLVINVFLLPPLDVLTTWLAIVGMLFVMAFPWYHDGVVRALAVFGYAFCSAPFLWASVVRMMDSLQTMLERDPFFSRIGEPTQETEFSKLY

SEQ ID NO: 96333 - DNA, 2013 bp, Zea mays
  misc_feature: Ceres CLONE 1601352
  misc_feature: Encodes the peptide sequence at SEQ ID NO. 96334
aatttcggaagctagctagctctgctcggggctcctccttcccccagtaacaactaacaagtctacacacaggggacaccacaagtacatcgccaccaacggaggaggaactaagaagaaccccgatgacaattgcagccgcggtgaccgcgcccacgtccgcgccagtgcacgtcgcgccgcgccacgccagccccgcggtccagccgcgcgccgcgccgcgcagggagccgtcgccgctcaaccccaacgcgccggcgcaggcgctccgctcggccagccccggcggcggcgggtcttccgcggccccggacggcgccagggctcacatcgccaaccttgacaaggtgctcgggaagccgccgcaggtgccgaggcccgcgagccacgccgccgccagcaggcagggccagggccaggacggcgagcaggagccgctcaacgtccggcacggcctgctcaacgcgctcaacctctccttcttcgtgcccatgcccgggatgcgggcgcggacggctgccgacgagcacatgtcgccgcgcagcctcatgcacatgcagcagctcctctccgccgactccccgcgggcatccccgcggtgcaccatcgccccgcgctggcgcagcctccacggggagggcggctgggagggcctcctggacccgctggactccgacctccgccgcgagctcctccgctacggcgacttcgtgcaggccgcgtaccaggccttccactcgctgcccaccgcgtcggcgaggcaccgcggcctcatgctccccgaccgctcctaccgccccacgcgcagcctcttcgccacctccgcgctgtccatgccgccgtgggccaagcgccccaacacgcccgagtggctcacgcagcagtccaactgggtcggctacgtcgccgtctgcgagtcggagcgggaggtcgcccgcatgggccgccgcgacatcgccatcgtgctgcgcggcaccgccacctgcctcgagtgggccgagaacctccgcgcctcgctcgtgcccctcgacggcggcgacagcagcgacggcgccgacacgccgccgccggagccagagcccaaggtggcgcggggcttcctcagcctctacaagacggccggggacaaagtcaggagcctgtccgaggaggtcatggacgaggtgcgccgcctcatggacaagtacaagggcgaggagctcagcatcacggtcgtcggccacagcctcggcgccgccctggcgctcctcgtggccgacgaggtcgccacctccatccccgacgcgccccccgtcgccgtcgtctccttcgggggccccaaggtgggcaacgccgcgttcgtcgacaggctcgccagcagcggcaaggtcaacgtcctgcgcatcgtcaacgccggcgacgtggtcaccaaggtgcccggggtggcgccgcggctgcccaacaagaaggagcagtaccagcacgtgggcgcggagctccggatcgacagcaagaactcgccgtgcctccgcccggatgcggggcccgcctgccgccacgacctggaggcgtacctgcacctcatcgacggcttcaccgggacggggcgcccgtttcggcacgacgcgcgccgcagcgtcatccgcctcctgcagctgcagaggggcaacgtcaagaaggagtacgtgaaccgggcgcgcgagctcggcgtcgaccccgccgcgccggcggacgtcagccggagcatggcgtacgggaactgcgccgtcgccagcccctcgtgagggatcaaattattattacgtctcctttggtggaccgtcatgtaaattttgtaggagggaaagaagaattctttcgttagttgccggtgcgatccgggaaagatctcccgtcttccgtttcgtttcgttttgacatcgatgcatgtacaggaccaaaaaaaaaatcaggcaagccgcaagcgcaagtgcgtgcgcagcccaatcaataagtgaaagcgtgtcttgatgtgttcaaaaaaaaaaaaaaaaa

SEQ ID NO: 96334 - protein, 545 aa, Zea mays
  misc_feature: Ceres CLONE 1601352
  misc_feature (278)..(435): Pfam Name: Lipase_3 Pfam Description: Lipase (class 3)
MTIAAAVTAPTSAPVHVAPRHASPAVQPRAAPRREPSPLNPNAPAQALRSASPGGGGSSAAPDGARAHIANLDKVLGKPPQVPRPASHAAASRQGQGQDGEQEPLNVRHGLLNALNLSFFVPMPGMRARTAADEHMSPRSLMHMQQLLSADSPRASPRCTIAPRWRSLHGEGGWEGLLDPLDSDLRRELLRYGDFVQAAYQAFHSLPTASARHRGLMLPDRSYRPTRSLFATSALSMPPWAKRPNTPEWLTQQSNWVGYVAVCESEREVARMGRRDIAIVLRGTATCLEWAENLRASLVPLDGGDSSDGADTPPPEPEPKVARGFLSLYKTAGDKVRSLSEEVMDEVRRLMDKYKGEELSITVVGHSLGAALALLVADEVATSIPDAPPVAVVSFGGPKVGNAAFVDRLASSGKVNVLRIVNAGDVVTKVPGVAPRLPNKKEQYQHVGAELRIDSKNSPCLRPDAGPACRHDLEAYLHLIDGFTGTGRPFRHDARRSVIRLLQLQRGNVKKEYVNRARELGVDPAAPADVSRSMAYGNCAVASPS

SEQ ID NO: 96335 - DNA, 2646 bp, Zea mays
  misc_feature: Ceres CLONE 1601382
  misc_feature: Encodes the peptide sequence at SEQ ID NO. 96336
aggcaggtcctgtgcataatccaccatctcgctcacaggctcgccgcccccgccggcaatggagggcgttcacagcctcctggcccggcccaactccgcgccgttcgccttctcaccgctgcccctccgcaggagccacaggccgccaccgcctggcccctccacctgccgcgccgccagccgctgggccgaccgcctcttcgccgacttccacctcctccccgccgccgccgacccgccagccgcggcctcctcttcctcctcgtccccgttcgtcccgatcttccccgaagccgccgaccgcgccttgcccctcccggtcgacttctacaagattcttggtgcggagccacatttcctaggcgatggcattcggagggcgttcgagtcgcggatagctaagccacctcagtatgggtacagcacagaagctcttgttgggcgacggcaaatgctgcagattgcccatgatactctcacaaaccagagctcgcgcaccgagtacgaccgtgcgctttccgaggaccgtgatgcggcactcaccatggatgttgcctgggataaggttccaggtgtgctgtgtgtgcttcaggaggctggggaggcacaactggtgttagcaactggagagcacttgcttcaggaccgtccacctaagcggttcaagcaggatgtggtgctagcaatggcattggcttatgtggacatatcaagggatgctatggcagcaagccctccagatgtaatctgctgttgtgaggtgcttgagagggcactgaagctcctgcaggaggatggtgcaagcaatcttgcacctgaactgcttgcacagattgatgaaactttggaggagattacacctcgttgtgtattggagcttcttgctcttcctactgatgaaaaacataaaaataaacgccaagaaggtctgcaaggtgcaaaaaacatattgtggagtgttggcaggggtggtattgctactgttggaggaggattttctcgtgaggccttcatgaatgaggctttcttgcagatgacatcagctgagcagatggatttcttctctaaaacaccgaatagcataccacctgaatggtttgagatctatagtgtcgcacttgcccacattgctcaagcaattgcaagtaaaaggccacaattcatcatgatggcagatgaactcttcgaacaacttcagaagttcaatataggttctcaatatccttatgaaaacgagatggacctcgcattagaaagggcactctgctcgttacttgtgggggatatttgcaattgcagaatgtggcttggaattgataatgagtcctcgtcatatagggaccccaaaaatatcgagtttgtggtgaataactctagcatgaacgaagagaatgatcttcttccagggctgtgcaagctcttggagacatggcttgtctccgaggtattcccaaggagcagagatacccgagggacgcagttcagactgggagactattacgacgacccaaaagttctaagctacttagaaaggatggaaggcggtggtgcttcccatttagctgcagctgccgctatagcaaaacttggtgctcaagctactgctgcgcttggtactgtaaaatcaagtgctcttcaagctttcagtaaggttttcccattgacagaacagctagacatgtcaggcaaggatatcccaagtgatgatcttgataaatctcttgaaaaactcgcccaaggaagtgttgctggagacgctatccatgattccagaaatgacgccttgaagattatctctgctggtacactgcttgcactatttgcagtgttaggtctcaagtgcttgcctcgtaacaagtcacttcctgctcttaggggcgagtatgggtctgtggcggttgttgactccattgatggtccagcggcagatgaagagccactggaaatccctaggatggacgcgaagttggctgaagacattgttcgcaggtggcaaagcatcaagtccaaggctttggggccagaacacactgtcacggcattgcaagaggtcctcggcggcaacatgctgaaggtgtgggcggaccgagctgcagagatcgagcgccacggctggttctgggagtacgcgctctctggcgtgacgatcgacagcatcaccgtctccgtggacggccggcgggcagcggtggaggcgacgatcgaggaggtgggccggcttaccgacgtgaccgaccctaagaacgacgacgcgtacgacaccaagtacaccgcccggtacgagatgacctactccaggccagcagggtggaggatcaccgaaggcgcagtcctcaggtcgtaggtagaacggctgtgcttgtgcagctgcagcaggagtaggcgagtagcggtaagctcgattcccattcttttcttttcttttggcagcgtgtgtaaataaacagtgtgagcactggctcgttccagtactagaaagcttggttaggttgctgagtgatgagctcctgaggtcgaaatttgtcatgtagtttttattgatagataatttggtgttactattgctgggtcagatcctctgaaacgattgatcttaatgaaggcggcagtgcatcactgcttaccacagaaaaaaaaaaaaaaaaa

SEQ ID NO: 96336 - protein, 761 aa, Zea mays
  misc_feature: Ceres CLONE 1601382
MEGVHSLLARPNSAPFAFSPLPLRRSHRPPPPGPSTCRAASRWADRLFADFHLLPAAADPPAAASSSSSSPFVPIFPEAADRALPLPVDFYKILGAEPHFLGDGIRRAFESRIAKPPQYGYSTEALVGRRQMLQIAHDTLTNQSSRTEYDRALSEDRDAALTMDVAWDKVPGVLCVLQEAGEAQLVLATGEHLLQDRPPKRFKQDVVLAMALAYVDISRDAMAASPPDVICCCEVLERALKLLQEDGASNLAPELLAQIDETLEEITPRCVLELLALPTDEKHKNKRQEGLQGAKNILWSVGRGGIATVGGGFSREAFMNEAFLQMTSAEQMDFFSKTPNSIPPEWFEIYSVALAHIAQAIASKRPQFIMMADELFEQLQKFNIGSQYPYENEMDLALERALCSLLVGDICNCRMWLGIDNESSSYRDPKNIEFVVNNSSMNEENDLLPGLCKLLETWLVSEVFPRSRDTRGTQFRLGDYYDDPKVLSYLERMEGGGASHLAAAAAIAKLGAQATAALGTVKSSALQAFSKVFPLTEQLDMSGKDIPSDDLDKSLEKLAQGSVAGDAIHDSRNDALKIISAGTLLALFAVLGLKCLPRNKSLPALRGEYGSVAVVDSIDGPAADEEPLEIPRMDAKLAEDIVRRWQSIKSKALGPEHTVTALQEVLGGNMLKVWADRAAEIERHGWFWEYALSGVTIDSITVSVDGRRAAVEATIEEVGRLTDVTDPKNDDAYDTKYTARYEMTYSRPAGWRITEGAVLRS

SEQ ID NO: 96337 - DNA, 1781 bp, Zea mays
  misc_feature: Ceres CLONE 1601487
  misc_feature: Encodes the peptide sequence at SEQ ID NO. 96338
aacacgaccccttctcctctcgttctcgcccagtcgcaccgtcccgtctccaacccgactctgaaatccacgagctcttccccctcgtcctcaccccgcccctccctgctctccgcctccccgtccccgtccccgcccccgtcgctacccacaagcacctccggaggctccaggcacccacctcctgcacccggcgtacctcgcggcggcggcgcgcgaacgtcccgctccccggtgagtaacggagagacggagccatgagcggaggggtggagccggataccccgcccggtagcagcagcagcagcagcaggagcgggggcagcacgcccgtgggcggcaagccgccacgccaccacctcacgtccatccgccactgcgccagcagcgcccgcatcgccgctgcctccgccgaattcgggctggagtcggggacgctcagcttgatttcacctaccgcagacatccgtccgggcttcttgcctgtgttcaggtcggggagtttcgcggatattggacccaaatccttcatggaggacgagcatgtctgtgtggacaacctcgtcgagcaccttggactccgtggcccgggcatccctgcaccgggtgccttctatggggtgtttgatggccatggtggtagtgatgctgcctgttttgtccggaagaatatactgaagttcataaccgaagattgccacttccccaacagcatcgagaaggcaatcagaagtgctttcgtaaaggctgaccatgcgattgcggattctcagtctcttgaccggaattctgggaccacggcgttgacggtccttatatctggcaggacactgcttgtcgcgaatgccggtgactgtagagccgtattaggaaagcgaggccgagcttttgaactctcgagagaccacaaacccagctgcagcgtcgagaagctcagaatcgaaaaccttggcggtaccgtcttcgatggctacctcaacggtcagctggctgtagcaagggcgatcggtgactggcacatgaaaggctccaaaggctctgcgtgccctctcacaccggaacctgagtttagggaggttaggcttaccgaggaagacgagttcttgataataggctgcgatggcctctgggacgtgatgagcagccagtttgctgtctccatggtcaggaaagagctgatggaacacaatgacccacagcggtgctcgcgggagcttgtccaggaagctcttaggcgcgactgctgtgataacctaaccgtagtcgtcgtgtgcttctcagatgacccgccccctcagatcgaggtcccgagattccgggtacggagaagcatctcaatggaagggctgcatacgctgaggggagctcttgacagtaacgtttgagctccgaaagtgtaccttcgcctgcaacttgtgtcgtggaggattcttctctcttctttgttgtttggtctgttggaagttttgctccgctcggctcatcggtgttttgcgatatagatctcggaataagttttgtagaattattttggaaggaaatttttgttgaggtgtaggctaattaatcttcctttgttgaggccaccattttgttgttggttgctcacaatgtaatcgagcaattaaccggcacgttgttctggtacgaatgagagttatagcagctgatcgtttttggtctttgttcagaattccacttgtatggttggacgagtcccctgttcattattatcagaaccaaaagagaataaagttatgggatgaatcctcaaaaaaaaa

SEQ ID NO: 96338 - protein, 375 aa, Zea mays
  misc_feature: Ceres CLONE 1601487
  misc_feature (78)..(333): Pfam Name: PP2C Pfam Description: Protein phosphatase 2C
  misc_feature: SWISSPROT Homolog: EC 3.1.3.16 Phosphoprotein phosphatase
MSGGVEPDTPPGSSSSSSRSGGSTPVGGKPPRHHLTSIRHCASSARIAAASAEFGLESGTLSLISPTADIRPGFLPVFRSGSFADIGPKSFMEDEHVCVDNLVEHLGLRGPGIPAPGAFYGVFDGHGGSDAACFVRKNILKFITEDCHFPNSIEKAIRSAFVKADHAIADSQSLDRNSGTTALTVLISGRTLLVANAGDCRAVLGKRGRAFELSRDHKPSCSVEKLRIENLGGTVFDGYLNGQLAVARAIGDWHMKGSKGSACPLTPEPEFREVRLTEEDEFLIIGCDGLWDVMSSQFAVSMVRKELMEHNDPQRCSRELVQEALRRDCCDNLTVVVVCFSDDPPPQIEVPRFRVRRSISMEGLHTLRGALDSNV

SEQ ID NO: 96339 - DNA, 1871 bp, Zea mays
  misc_feature: Ceres CLONE 1612283
  misc_feature: Encodes the peptide sequence at SEQ ID NO. 96340
aaaacagtacgtactgtctagagtacaagtgagtagttaagcaagtgcctgtaaaccaagcttgcttgcgacttgcgagacaacacacaagtacacaacacaacagccatggcagtggtagacaggtgggcgggcctgggttcggcgctcgcgagcttcctcttcctctggtccatggtgcagagacacgtgcccgtcaccatcagccaccgcgtcgccacctgggccaacaagctcgtctcctacttcaacccctacgtcgagatcaccatctccgagtacggcgccgagcgcttccgccgcagcgacttcttcctcgccgccgaggcctacctgtccgacgcttgcgcgccccgcgcccgcaagctcaaggccgagctcggcagggacagcagcaacctccaggtctccgtcggcgacaacgacgaggtcaccgacgccttccagggagccacggtctggtggtacgtcgtcaagaaggtgcccaggtccaacgtcatcagcttgtacgccaaccaagacgacccgcgcacctaccgggtcgtcttccacaggcgccaccgcgacctcgtcgtcggcaagtacctgccccacgtcctcaaggaaggacgcgccgtcaccgtccgcaaccgccagcgccgcctcttcaccaacaaccccagcggcggcggccgtgggaggggcgacgtctggagccacgtcccgttcgagcacccgtctacgttcgacacgctcgccatggatcccgaagacaaggaggctgtcgtcgacgacctggaggcgttccgggaggccaaggactactacaccaaggtcggcaaggcgtggaagcgagggtacctgctctatggtcccccgggcaccggcaagtccaccatgatcgcggccatggctaacttgctcgactacgacgtctacgacctcgaactcacggcggtcaacaacaacaccgacctgcggaagctattcatcgagaccaccgggaaatccatcatcgtcgtcgaggacatcgactgctccgtcgacctcaccggcaagcgcaaggacaagaaatccgaacgcgaggccgacgacaagcccaagctgccgatggagcctgacaaggacgaaggcagcaagattacgctttcagggatgctcaacttcatcgacggcctgtggtcggcatgcggcggcgagcgcatcatcatcttcaccaccaaccataaggacaagctggaaccggcgctgatacggcgaggcaggatggacaggcacatcgagatgtcctactgccgcttcccggccttcaaggtgctcgccaagaactacctggacgtcgaggagcacgagctattcgaccagatagggcagctgctcgaggagaccgacatgtcgccggcagatgtggcagagaacctgatgtccatgtccaagaagaagaagaaggacgccaacgcgtgcttggagagtcttgtgaaggctctgaagcaggccaaggaggaggcggccaaggcgaaggtggaagcagaggcaaagaagaaggtagaggcggcggccgaggcagcaaagtccaaagaggaagacgaggcaaagaaaggcagcggataagacgaaggcgacaaaacttcagaatcgatgagcaacgtacgaacacacatcaaaagcgatgacaaatgacaagtctaggctcgtgattctaataggagtcatcatttaaaaaaaggcttaaattgtagaatcgttgaaattaaggaacaatgtacaccgtctctggaaatttgttgcaactcttccacttgcctataggttggtaatggatatataaatgtttattcacgagtcgtttgatctcttaattaattttagtttaaagtaaaaaaaaaaaaaaa

SEQ ID NO: 96340 - protein, 493 aa, Zea mays
  misc_feature: Ceres CLONE 1612283
  misc_feature (243)..(440): Pfam Name: AAA Pfam Description: ATPase family associated with various cellular activities (AAA)
MAVVDRWAGLGSALASFLFLWSMVQRHVPVTISHRVATWANKLVSYFNPYVEITISEYGAERFRRSDFFLAAEAYLSDACAPRARKLKAELGRDSSNLQVSVGDNDEVTDAFQGATVWWYVVKKVPRSNVISLYANQDDPRTYRVVFHRRHRDLVVGKYLPHVLKEGRAVTVRNRQRRLFTNNPSGGGRGRGDVWSHVPFEHPSTFDTLAMDPEDKEAVVDDLEAFREAKDYYTKVGKAWKRGYLLYGPPGTGKSTMIAAMANLLDYDVYDLELTAVNNNTDLRKLFIETTGKSIIVVEDIDCSVDLTGKRKDKKSEREADDKPKLPMEPDKDEGSKITLSGMLNFIDGLWSACGGERIIIFTTNHKDKLEPALIRRGRMDRHIEMSYCRFPAFKVLAKNYLDVEEHELFDQIGQLLEETDMSPADVAENLMSMSKKKKKDANACLESLVKALKQAKEEAAKAKVEAEAKKKVEAAAEAAKSKEEDEAKKGSG

SEQ ID NO: 96341 - DNA, 489 bp, Zea mays
  misc_feature: Ceres CLONE 1612404
  misc_feature: Encodes the peptide sequence at SEQ ID NO. 96342
aggccacttacctgcagtcaccactcccaagccagtacccacagtcctacgagcagtcgcacgcaagtgtcaagagacaaaacggtcgacatggctcgcacgcaatctgccgtagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccgcctgcaactgcctcaagaacgccgccaggggcgtcagcggcctcaacgccggcaacgccgccagcatcccctccaagtgcggcgtcagcatcccctacaccatcagcacctccaccgactgctccaggcacagggtgaactaaaaactagaccacgcgcgacgacggccg

SEQ ID NO: 96342 - protein, 123 aa, Zea mays
  misc_feature: Ceres CLONE 1612404
  misc_feature (32)..(117): Pfam Name: Tryp_alpha_amyl Pfam Description: Protease inhibitor/seed storage/LTP family
MARTQSAVAVAVVAAVLLLAAAATTSEAAITCGQVSSAIAPCLSYARGTGSGPSASCCSGVRNLKSAASTAADRRAACNCLKNAARGVSGLNAGNAASIPSKCGVSIPYTISTSTDCSRHRVN

SEQ ID NO: 96343 - DNA, 976 bp, Zea mays
  misc_feature: Ceres CLONE 1613199
  misc_feature: Encodes the peptide sequence at SEQ ID NO. 96344
aacttcgccgagaaggaagaatcagccgtgcggttggacacggagatgccgagaagatggacgcacggagtcaccacgaacctatcgactttttatctccagatccagattagctaccacggcaccgccagcccggacggctataaagacgaggcccatctcgaaatcgacggcgatgaagaagaccagttcccctctcctgatcgtcctgttcctcacagcagcagccatggcggccgagccggagaagcaggcggcccccgcggcacaggagacggccgtgcacatcgtgtacgttgaccgccccgaggacgccgaccctgaggagttccacatccgcaccctcacccccgtcctcggcagcgaacagaaggccagggacgcagtgctctaccactacaagaacgccgccagcggcttctccgcgaagctcaccccccagcaggtcaaggatctcaagggtgagttctcccttcaaatattttcctgcggttaagctgtactccttgcttcgggatgccattgcttcatcccacggctgtactccggaaattttgcattcagagcattattcttgtttctggttgcaccaaatgatcaaatcactggatgcccatcgtgtatgaaatccttgcttatttcagcttttctaagaacctggttgtgggaagaatgtctgtgaggagaatccgagaagatgaagggatctatatggtttaggatctagaaagtgaagtatttctattatcacgacgactcgaccgattctatgttcatgttgattttgaacggttttcacccaagcgattctcacaaaagtggaatgaaaagctgagcgtttgacaatccgcttggccagaagctgaagcaaatagggcctcaatctccaagccgtagattgtttgatgcttggaattaattttttgtaggataataattaatcaaagtgattacttctcaaaaaaaaaaaaaaaaa

SEQ ID NO: 96344 - protein, 106 aa, Zea mays
  misc_feature: Ceres CLONE 1613199
  misc_feature (35)..(101): Pfam Name: Subtilisin_N Pfam Description: Subtilisin N-terminal Region
  misc_feature: SWISSPROT Homolog: EC 3.4.21.25 Cucumisin
MKKTSSPLLIVLFLTAAAMAAEPEKQAAPAAQETAVHIVYVDRPEDADPEEFHIRTLTPVLGSEQKARDAVLYHYKNAASGFSAKLTPQQVKDLKGEFSLQIFSCG

SEQ ID NO: 96345 - DNA, 944 bp, Zea mays
  misc_feature: Ceres CLONE 1613863
  misc_feature: Encodes the peptide sequence at SEQ ID NO. 96346
  misc_feature (769)..(769): n is a, c, t, g, unknown, or other
ttttctcatgtcggctaaacattttcccattcttgatttacaacattatttcagtgcagttttattaactcctttttttcctttagcatgtcttcatttagtttcttattatgcccatccttttatttttgactatgaagcaggctttctggaatcacatttcttgagaactatctgttggagagctaaactaggctcttgttcatattatggatcagcaagctaagattgatgctgattttttttgaaccaactgtactcttagatgagacacattaccaggaggggtacagaaatggctataatgatggtttggcatctggaaatgaagaggggaggcaggttggtttaaagatgggtttccaggtcggtgaagaactgggtttctttcagggctgtctggatgtgtggacgtctgcaattctcattgatcagaatgccttcacagctcgggtcatgaagaatatcgagcaactggctgcattggtgggcagctatccgctgtccgatccggagaatgaacaaattcaagacgtgatggagaagataaggctgaaattcagggtcatcactgcaagcttaggggtgaagttagagtatgaagggcaccccaaattcatctaaacaggatgctgaggatctgtgagcggtgattgaaattacattttagtttctccgcccttgctgtttaaagctcttcaacttattggcatcatgaggaactgccgtgagacatcaatggtcagagtccgaccattaaccacatatnatagttttaacaatgtctcaagttttgtgttattacctgttgtctgttgtctgtcatatgtaatagtttcctttcagaaggcaaaagcacttccttcctattttctttgaagtacttgttcttatttaatagataatgaacacatcccagatttatgctaaaaaaaaaaaaaaaa

SEQ ID NO: 96346 - protein, 130 aa, Zea mays
  misc_feature: Ceres CLONE 1613863
  misc_feature (5)..(117): Pfam Name: DUF1715 Pfam Description: Eukaryotic domain of unknown function (DUF1715)
MLIFFEPTVLLDETHYQEGYRNGYNDGLASGNEEGRQVGLKMGFQVGEELGFFQGCLDVWTSAILIDQNAFTARVMKNIEQLAALVGSYPLSDPENEQIQDVMEKIRLKFRVITASLGVKLEYEGHPKFI

SEQ ID NO: 96347 - DNA, 559 bp, Zea mays
  misc_feature: Ceres CLONE 1614398
  misc_feature: Encodes the peptide sequence at SEQ ID NO. 96348
aaatcccactcgcgccatcacccgacgcaaagaccactctcagccagcctcaaggcgcgcgcaacgccgctcctgcgcttgcgtgggtcgtcggcatggacaagcaggatgagaggaagaagccccacgggaaaacagaccccaagaggggcgacatcatgaagcggatcataaaggacctcaccggcggcggcaacgacggcggcggcggtgccagtgacggtggtggtaacagcggctccggctccacccccgctggcgccgactgacgcacatggcgcgtgcgtacccagttacgacggcaggggcgagcggtgagcccccgtgaatccgtgatggtttgtgtagttgttgctttctcgaatctggttatctggcaaggctagctgccggctgcgtatcgtacgttagtgtagggggcggtcagcgttcggatggcgggatgggtggtgtgcaatttaagactgtgctgtgtaacacttgtgctcaataattgtggatgatcaaatcgatggggccgcacgcccgcacctatttgcgtcaaaaaaaaaaaaaaaaa

SEQ ID NO: 96348 - protein, 57 aa, Zea mays; identical to SEQ ID NO: 60329
  misc_feature: Ceres CLONE 1614398

SEQ ID NO: 96349 - DNA, 1916 bp, Zea mays
  misc_feature: Ceres CLONE 1615379
  misc_feature: Encodes the peptide sequence at SEQ ID NO. 96350
aagccacgcaacaccgcagcatttcttcttcttcttgtcagtagctgtggcctgcacagctagcgccactgtaccgccattgttttgttagcatggccccgagtaacatcgtcgttcagagcagcagcactccgccggttgccggcggcgacgaggagttcgcgccgtctgtatggggagatttcttcgtcacctatgcccctcccgtctcacaggcatcagagcagcggatgagtgagagagcggagctgctcaaggcgcaagtacgtcaggcgttcgatgctgccagcatggatgttgcaggtctggtcacgtacgtcgacaccctcgaacgcctcggcttagacaaccacttccgcgacctcatcggagctgccctggaacgaatcggagctgaggagctgccggagcacggcggcggcctgcacatcgtcgcgcttcggtttcgcctgctccggcagcatgggatatgggtatctacagatgtgttcgacgcgttcagagaggacgcgggcggtttctgctcgagcctctgcagtgacgaccctaggggtctcctgagcttgtacaatgcggctcacatggcagtacccggcgaggtggtcctcgacgacgccatcgccttcgcgaggggccgcctcctggacatcatcagcaaaggcgaggtcaggtcaccggtgtcagagcagatcacacgagccctcgacatccccctcccacgatttacgaggcggctggaaaccatgcactatattgccgagtatgagcatgaagaggcacacgacggcctgctgcttgagctcgctaggctcaactttgtccttgtgagagcgcttcacctcagggagctgaaggacctgtcactatggtggagggatctctacaacactgtgaagctcccgtacgctcgggaccgtatggtggagatctacttttggacctgtggtatgcttcatgaggaggagtactccctggcacggatgttcttcgccaagacgttcgggatggtgtcactgatggacgacactttcgatgtccatgctactctagacgagtgtcacaagctcaaagaagctatgcagagatgggatgaaagtgaggtctccattctacccgagtatctacgcttgctgtatatcaaaacacttagcaacttcaaagagtttgaggagatcttggaaccgaacaagaagtaccgcatggcttacacaaaagaggcatacaagttgtgctccaaaaactacctaaaggaagccatctggtctaaccagaaataccagccaagcttcaaggagcatgaggagctatcaatcatgacctcaggcttgccgatgctcacgatcctaacactaatgggcttcggtgacgaggcaaccccggaggcgttcgaatgggtaagcagtgttcctgaaatggtccgcgctggttcgcaggtcactcgcttcctcaacgatttgtcttcttacaagttgggaaagaacaagaaagatatgcctggctctgtggagacctacatggtagagaatggcttaacaggagatgaggctgcagcggcaatcgcggcacttctagagaacaggtggagaatactaaaccaaacaaggatggagatagatcacacgctactgccagcggcgcaggtggtggtcaacatggcgagggcaaatgagatcatttacctccacggcagggacgcctacaccttcggtgctgacctcaaggaccttgtcaccacactcttcctcaagcaagtgctccctctctagacaatactctgatcacacaaccagattggctataacgattctcgtgttgtattacgctttgtgtttcattatgcacgctatatatatgatcaatgtacctgtttctattatattgatggtaatataatattctaaaaaaaaaaaaaaaaa

SEQ ID NO: 96350 - protein, 557 aa, Zea mays
  misc_feature: Ceres CLONE 1615379
  misc_feature (233)..(501): Pfam Name: Terpene_synth_C Pfam Description: Terpene synthase family, metal binding domain
  misc_feature (28)..(228): Pfam Name: Terpene_synth Pfam Description: Terpene synthase, N-terminal domain
  misc_feature: SWISSPROT Homolog: EC 4.2.3.13 (+)-delta-cadinene synthase
MAPSNIVVQSSSTPPVAGGDEEFAPSVWGDFFVTYAPPVSQASEQRMSERAELLKAQVRQAFDAASMDVAGLVTYVDTLERLGLDNHFRDLIGAALERIGAEELPEHGGGLHIVALRFRLLRQHGIWVSTDVFDAFREDAGGFCSSLCSDDPRGLLSLYNAAHMAVPGEVVLDDAIAFARGRLLDIISKGEVRSPVSEQITRALDIPLPRFTRRLETMHYIAEYEHEEAHDGLLLELARLNFVLVRALHLRELKDLSLWWRDLYNTVKLPYARDRMVEIYFWTCGMLHEEEYSLARMFFAKTFGMVSLMDDTFDVHATLDECHKLKEAMQRWDESEVSILPEYLRLLYIKTLSNFKEFEEILEPNKKYRMAYTKEAYKLCSKNYLKEAIWSNQKYQPSFKEHEELSIMTSGLPMLTILTLMGFGDEATPEAFEWVSSVPEMVRAGSQVTRFLNDLSSYKLGKNKKDMPGSVETYMVENGLTGDEAAAAIAALLENRWRILNQTRMEIDHTLLPAAQVVVNMARANEIIYLHGRDAYTFGADLKDLVTTLFLKQVLPL

SEQ ID NO: 96351 - DNA, 1951 bp, Zea mays
  misc_feature: Ceres CLONE 1615569
  misc_feature: Encodes the peptide sequence at SEQ ID NO. 96352
aggatctggaggaggagaggcgttgaggagtagtttcaaaactcccacggcttcgcgcaagaccgtgccgccgtgcgcgctcaccgctcggcgcttcgtccccaaggcaccgcggacgccgagcaacccgcataaatcccctgctccgaagtccgaactagttgctccaccgaatcctcgaatcgaatcgcgaccagatcctcgcccccagccccccacgcgctcccccatcacccccaccccgcgcttatgcaccaaaccccacttcgtttctcactgcaatccgccggccaaccgatcccacccccacctcttcggcgcaatgacggccgtcgcgacgccgacgccgccaccgcctcggcagctgagcctggaggaccttaaggcgatatccgtgctcgggcgcggcgccaagggcgtcgtgttccacgtcgtgcacgcccctggagaaccggacggcgagggcgagggcggcgccgcggccatggcgctcaaggcggtctcgcgggaggccgcgcggcacaagaaggcggccagcggggacggggacggggacggacaccgccggatctggttcgagcgcgacgtgctcctgtcgctgcggcacccgctgctcccctccctgcgcggcatcctcgccaccgaggccgtcgtcggcttcgccatcgaccgctgcggcggcggggacctcaactcgctgcggcggcggcagaccgagaagatgttctccgactccgtcatacggttctacgccgcggagctggtgctggcgctcgagtacctgcacagcctcggcatcgtgtaccgggacctcaagccggagaacgtcctcatccaggacagcggccacatcatgctcgtcgatttcgacctctccacgcggctcccggcgaggccgcaggagcctgacgcgccggtgaccagtcccaagccggcgcctccggtcgccgcgccgtcgccgagccgcggcagtgcaaggaagccagcgggcggcgccctgtgcttcccattccgcaccgccaccgccacaaagcctgccgcgccggccacggactcgccgtcgccgctgtccacctcgcggacggcctcctcgtcctcctcgtcgtcgtcgtcctcgacgtcgaggaccacggcctcctccgcggcatcggccggcgccggaagtcgaactcccgcgaagtcgaactcgttcgtggggacggaggactacgtggcgccggagatcatcgcggggcgcggccacgactttacggtggactggtggggcctgggcgtggtgctatacgagatgctctacggccgcacgccgttccgggggcagagccgcaaggagaccttctaccgcgtcctcaccaagcagccggagctcgtcggcgagcagacgccgctgcgcgacctcatcgcccgcctcctcgagaaggaccccgagaagcgcatcggcgcgcgcggcgtcaaggcccaccctttcttccgcggcgtcgactgggaccgcatcctgcaggtggcgcgcccgccgttcatcccgacgccgccgcaggacgagggcgaggacgaggacggcggcgaggcgcttgacgtcgagaaggtcgtccgcgaggtgttcgcgtccaacgacgcggagggcgggaaggcttggcctgtggcggacggaggccgtgtcggcggcgacggcgattgcgacgggaggggagatcaatctaaagatggcgatttctccgtgttcttctgagctatttattttcttttgatttgttttttcttttcttgtttttaaaaacaatagctactagtggtagtagatgtatatgctgtgtatggagtattatttgttctcctcaaggatgatgtgatttagcagctgatattagggagtgagtacggcgcaatgatggccggtggagtacatacataaattataaagagattctcctgctaaaaaaaaaaaaaaaaa

SEQ ID NO: 96352 - protein, 468 aa, Zea mays
  misc_feature: Ceres CLONE 1615569
  misc_feature (20)..(383): Pfam Name: Pkinase Pfam Description: Protein kinase domain
  misc_feature: SWISSPROT Homolog: EC 2.7.11.1 Non-specific serine/threonine protein kinase
MTAVATPTPPPPRQLSLEDLKAISVLGRGAKGVVFHVVHAPGEPDGEGEGGAAAMALKAVSREAARHKKAASGDGDGDGHRRIWFERDVLLSLRHPLLPSLRGILATEAVVGFAIDRCGGGDLNSLRRRQTEKMFSDSVIRFYAAELVLALEYLHSLGIVYRDLKPENVLIQDSGHIMLVDFDLSTRLPARPQEPDAPVTSPKPAPPVAAPSPSRGSARKPAGGALCFPFRTATATKPAAPATDSPSPLSTSRTASSSSSSSSSSTSRTTASSAASAGAGSRTPAKSNSFVGTEDYVAPEIIAGRGHDFTVDWWGLGVVLYEMLYGRTPFRGQSRKETFYRVLTKQPELVGEQTPLRDLIARLLEKDPEKRIGARGVKAHPFFRGVDWDRILQVARPPFIPTPPQDEGEDEDGGEALDVEKVVREVFASNDAEGGKAWPVADGGRVGGDGDCDGRGDQSKDGDFSVFF

SEQ ID NO: 96353 - DNA, 2120 bp, Zea mays
  misc_feature: Ceres CLONE 1615930
  misc_feature: Encodes the peptide sequence at SEQ ID NO. 96354
aatcagcagctggcgaggggccgaacagtgtctgcgcctggcagctcacctctctgctccttccttcggcctttccttccttccctccctccctccagagtccggagcagagcagtcaaccgggctgtcgtcgccattggtgcggtacgtgcgagcccgagcggtgcgacgcagggggggaggggccagtgagagagacgacacgcgagagcgaagccaagcgaaggaggagcttcctggcgcgcgcggatcgcggaggctgtatatatatagtcggagggcgcgcgctccggtccggtaacgtgctgcaggtggggggtggcgcagggcaggattaggcagggcagcgccgcgccggccggaccgcccgtccaggagccagggactttcggccatgggggacggtggtgctgacgacgcctcctcgccgccgccgcatgacgggggcttctcctacctcgccgtcttccacaactaccccctcgtcgccgccctgctcggcttcgccgtcgcgcagtccatcaagttcttcctcacatggtacaaggagaacaggtgggatcccaagcagcttatcggctctggtggcatgccatcatcacattctgccacggttacagcactagcagtagcgattgggttgcaagatggctttaactgctccctctttgcaacagcaactatatttgcaagtgtggtaatgtacgatgcttctggtatcagattgcatgctggaaagcaagcagcggtactgaaccaaatagtttgtgaacttccttctgaacatcccttgtctgaaacaagaccactgcgagaacttttaggccatacaccaacccaggttgttgctggcgcattgcttgggtgtacgatagccacagcaggacaattattcgtttgaactccgaaggtgcaggagaaatgttgtagcatttgcatcgcggggacttgagaagaagtttctctagtgttctgctactttaggtattggtaagattttcaacttggtgctgtagtgttgtcgaatgttgtaagctctgatggaaggtgattatttgtcaaggtgatgttcacaggattgttgtacagaacatttgttcgataatgtcatggttatgattgatgaaatctaaaatgtgattagaatagtgatgatttgtgaccaatagaaatggctccgaggtgagattttgggaagacaactggcttgggaatgagactttagaaccccagtacccagggttatatagcaaaacaagaagaaaattcataatcatcgcaaaagttttatcaaccccacaaccaaatattttctggcggagactgtgataggaccaaaattagtggcgtggaacgaattgtattcacgtatcgcgagggtccagctagaccaggtgaagatgagttcacctagggtctaactaagtcaaaaaaattcgaagttaagtcgctctaccaagccttgatcaaaatcaacatcccaaatcattgtcgtttggaagctaaagccccccctaaaaatcaaagtatccttgtggtatctaaaaaggggagtcatcctgacaaaggataacttagcttctatcacaaaaacgagacgatcaagcatcttctttttgactgtcattttgcgaggcgggtttggaacttcatttttctagcttttggtatttctagaccttctaacatccacaatatatttgggaacttgataggaggcttcggaaatgatcataaaggtctagctctacttggggcagcaactatatgttggtctatctcgctaggtagaaatgagttaattttttaaaacaaaatttctttatctcctttgcaggttacttttacggtagcctagaggcttcgcacatgggctgtgctacggaggcagaactcatgcaattttttgttaatgattacgcaacatttgactcaagtggccaaggactttttttttcccggaagcatggttgacggtctagtcttcggattgatagccactagtgtgtctttagattatgctgggttgtgtgctattgactttcaaggacttgtattacctcgatgtattattcttgaataaataaaaatccttccttttctaaaaaaaaaaaaaaaaa

SEQ ID NO: 96354 - protein, 168 aa, Zea mays
  misc_feature: Ceres CLONE 1615930
  misc_feature (22)..(167): Pfam Name: DUF212 Pfam Description: Divergent PAP2 family
MGDGGADDASSPPPHDGGFSYLAVFHNYPLVAALLGFAVAQSIKFFLTWYKENRWDPKQLIGSGGMPSSHSATVTALAVAIGLQDGFNCSLFATATIFASVVMYDASGIRLHAGKQAAVLNQIVCELPSEHPLSETRPLRELLGHTPTQVVAGALLGCTIATAGQLFV

SEQ ID NO: 96355 - DNA, 930 bp, Zea mays
  misc_feature: Ceres CLONE 1622179
  misc_feature: Encodes the peptide sequence at SEQ ID NO. 96356
actctgccctgcgccgccgccaacgctgcagccgcagttgccgcaggcgggaacttggacgtgctactcgcgactgctatcatctgttcccgcgtaggattcgttcacaatggcccgtgtgtatgtcggcaacttggatgcacgcgtgacttccggggaactcgaagatgagttccgtgtgtttggagttctgcgaagtgtttgggtcgcacgcaaaccacctggttttgcatttattgattttgacgacaggagggatgcagaggatgctattcgtgatctagatggtaagaatggatggaaagttgaactatctcgtagcaccaatggtcgtggcagtcgtgatcggcatggtggatctgagtcaaagtgctatgagtgtggtgagactgggcactttgcacgtgaatgtcgtctgcgcattggctctggaggtctaggcagtggaagacgtcgcagcaggagcaggagccgcagtcgcagccctagataccgcaggagtccgagctataatagaaggagctatagccctcgttatcgttctccaaggcgccgtactccttcaccggctcgtggacgcagctatagcaggtcgccatagtacaactgtgacaaatatgcatctccctcgttaacggagtaatgatggcagatactggtgtagcaggagcttggcctgaagcccgtgcctgattcttctctgtgtgaggacttggttcttggtttggctgtggggaacaaatttggaactgtcgtcaactgcatgacttcagttcaggtttaaaaccttatctagcttattgtgattgtcttgattatgccattaaagaacttttaagatttgtgtattatgccactaagacatattaccttctctgtgttaaaaaggcatgttctgcttaaaaaaaaaaaaaaaaaaaaaaaaaaaaa

SEQ ID NO: 96356 - protein, 163 aa, Zea mays
  misc_feature: Ceres CLONE 1622179
  misc_feature (4)..(70): Pfam Name: RRM_1 Pfam Description: RNA recognition motif. (a.k.a. RRM, RBD, or RNP domain)
  misc_feature (86)..(103): Pfam Name: zf-CCHC Pfam Description: Zinc knuckle
MARVYVGNLDARVTSGELEDEFRVFGVLRSVWVARKPPGFAFIDFDDRRDAEDAIRDLDGKNGWKVELSRSTNGRGSRDRHGGSESKCYECGETGHFARECRLRIGSGGLGSGRRRSRSRSRSRSPRYRRSPSYNRRSYSPRYRSPRRRTPSPARGRSYSRSP

SEQ ID NO: 96357 - DNA, 1159 bp, Zea mays
  misc_feature: Ceres CLONE 1623733
  misc_feature: Encodes the peptide sequence at SEQ ID NO. 96358
gttcgtttctctgcctctcgcctagtgtcgcggtccgacgaccggtgtcgccgccgccgcctctctaacgccaggtgctgaggccttcgccagcctctttgccggcgacgaaaacccaccagtcctttcaggatgaccaagtatacgaggaacaaaaaaagttcatcttctcacagtagttccagattcaaaagagtttccagaaaggagatgtcatttgcagtggagaaatacgcatggacaaatgcaacttgtccagtatgcatggaattcccacacagcgctgttcttctactctgttcatcacatggcaatggctgccgtccatatatttgtgcgtccagctaccagcactcaaattgtcttgatcagcttgtaatgtcatgcagaaaagaagcctctgaggacccagatgcaatagagcttatgtgtcccctatgccgtggcgaggtcaagggatataccttggttgagcctgctcggaagcagctgaatcgcaagaggaggagctgcatggaagacggctgttcgtatatgggcacatacagagagctctgcaagcatgtccaaaagaagcacccttctgcaaacccacgagctgtggaccccttgcatgcttacagatggaagcggcttctatttcgaagttcattgcatgatatgatttgttcaactacttcagaggctatgcgaaggttttgttctcacatgctgcagattgaggaggttatgactgctttgcgagagggtggtgatcatcgtggcgctaccaatgacgatcaactgatccatgatctcttgacctctcgctgaaatgtgagaacctgtgttgatcctgcaggcaatctttgcatgaatcctcaacttggcacccctgccgattcacattttctgacccgacaaagcaaactagtcttcatctgtcctcaatgaaacagactgttaaagctttgatggatttattcattcacagtgataatggctggttgaatggcacggggctttttttctactcatctagcctctagtatgtcatgcgatgcactgttcctgtgcaccctcccactgtatgactatgacaactgtttcttatggaacgcaatgtgttcctgttcataaaaaaaaaaaaaaaaaaaaagaaaaaaaaaaaaaaaaaaaa

SEQ ID NO: 96358 - protein, 226 aa, Zea mays
  misc_feature: Ceres CLONE 1623733
  misc_feature (36)..(179): Pfam Name: DUF1644 Pfam Description: Protein of unknown function (DUF1644)
  misc_feature: The sequence is a functional homolog of SEQ ID NO 1042 in the 10/225,066 US patent application
  misc_feature: The sequence is a functional homolog of SEQ ID NO 2650 in the 10/374,780 US patent application
MTKYTRNKKSSSSHSSSRFKRVSRKEMSFAVEKYAWTNATCPVCMEFPHSAVLLLCSSHGNGCRPYICASSYQHSNCLDQLVMSCRKEASEDPDAIELMCPLCRGEVKGYTLVEPARKQLNRKRRSCMEDGCSYMGTYRELCKHVQKKHPSANPRAVDPLHAYRWKRLLFRSSLHDMICSTTSEAMRRFCSHMLQIEEVMTALREGGDHRGATNDDQLIHDLLTSR

SEQ ID NO: 96359 - DNA, 2037 bp, Zea mays
  misc_feature: Ceres CLONE 1624895
  misc_feature: Encodes the peptide sequence at SEQ ID NO. 96360
atataaattccacaccgctcgctgccgtgcccgcacctgtgctgtgcataacgaacgccagcaaacaaacagcgccgcaacccaccctatagcgcaggaggagaggagcccctcctcccgttcccataaatcccattcgcacggcgaggcgagacgaggcgagggcaactgggcctgggctgccggcagagcttggaccgctcgccatggccggcggcggggagagggagggcgcgcaggcgatggactccggcgagaagcgcctcaacgagctcggctacaagcaggagctccgcagggagatgacgctgttcaagacgctggccatctccttctccacgatgacgctcttcacggggatcacgccgctgtacgggagcagcctgcagtacgcggggccggcgccgctcgtctggggctgggtcgtcgtctccttcttcacctgcttcgtcggcgtcgccatggccgagatctgctcctccttcccgaccactggttctctgtatttctgggctgcacatttggcaggtccagtctggggtccgttggcgtcttggtgctgcgcttggctggaggccatcggcctcattgccgggattggcacacaggcatacgcaggatcccaggtactgcagagcatcatcctgctctgcaccggcaccaacacgggcggtggctacctggcccctcgctggctgttcctggtcatgtacatcgggctgacactgatctgggccgtgctcaacactttcgcgctcgaagtcatcgcgttcctcgacgtgatctccatgtggtggcaggtgatcggtggcaccgtcattgtggtgatgctcccgctggtggccaagacgacgcagccggcgtcgtacgtgttcacccacttccagacggcgcccgacgtgacggggatcggcagcagcgcctacgccgtcgtcctgtccttcctggtcagccagtactcgctgtacgggtacgacgcggcggcgcacctgacggaggagaccaaaggcgccgacaagaacggacccatcgccatcctctccagcatcggcatcatctccgtgttcggctgggcgtacatcctggccctcaccttcagcatccaggacttcagctacctgtacaacccgaacaacgagaccgccggcacgttcgtgccggcgcagatcctgtacgacgcgttccacgggcggtacaacagctcggccggcgccatcgtgctgctgttcgtcatctggggctccttcttcttcggcgggctgtccatcacgacgagcgcggcgcgggtggtgtacgcgctgtcgcgggaccaaggcgtcccgctgtcgtcggtgtggcgccgtatccacccgcggcacaaggtgccggcgaacgcggtgtggctgtgcgcggcggtgtgcacgctgctgggcctgcccatcctgcgcatcaacgtggtgttcacggccatcacctccatcgccaccatcggctgggtgggcggctacgcggtgcccatcttcgcgcgcatggtgatgcgggaggacgacttccggccgggccccttctacctcggccgcgccagcaggcccgtctgcctcgtcgccttcctctggatctgctacacctgctccgtcttcctgctccccaccgtctaccccatcaagatggacaccttcaactacgcgcccatcgcgctcggcgtctgcctcggcctcatcatgctctggtggctgctcgacgcgcgcaagtggttcaagggccccgtccggaacatcaacgaccaccacaacggcaagggctgaacacctacgcacgcamgtcaagccaagcttcgactagaggtcacatcaagcgtttgactttcaaataggagtatgcaatatagacccacccaactgtactagattcgtctcactttttaatcttcggctgagaaattagttttataatccgactacatttaataccccgaacggaggttcaaacattcgatgtgataggggctaaattttagcaggggcaaaccaaacaccccctcaaaaaaaaaaaaaaaaa

SEQ ID NO: 96360 - protein, 525 aa, Zea mays
  misc_feature: Ceres CLONE 1624895
  misc_feature (35)..(516): Pfam Name: AA_permease Pfam Description: Amino acid permease
MAGGGEREGAQAMDSGEKRLNELGYKQELRREMTLFKTLAISFSTMTLFTGITPLYGSSLQYAGPAPLVWGWVVVSFFTCFVGVAMAEICSSFPTTGSLYFWAAHLAGPVWGPLASWCCAWLEAIGLIAGIGTQAYAGSQVLQSIILLCTGTNTGGGYLAPRWLFLVMYIGLTLIWAVLNTFALEVIAFLDVISMWWQVIGGTVIVVMLPLVAKTTQPASYVFTHFQTAPDVTGIGSSAYAVVLSFLVSQYSLYGYDAAAHLTEETKGADKNGPIAILSSIGIISVFGWAYILALTFSIQDFSYLYNPNNETAGTFVPAQILYDAFHGRYNSSAGAIVLLFVIWGSFFFGGLSITTSAARVVYALSRDQGVPLSSVWRRIHPRHKVPANAVWLCAAVCTLLGLPILRINVVFTAITSIATIGWVGGYAVPIFARMVMREDDFRPGPFYLGRASRPVCLVAFLWICYTCSVFLLPTVYPIKMDTFNYAPIALGVCLGLIMLWWLLDARKWFKGPVRNINDHHNGKG

SEQ ID NO: 96361 - DNA, 430 bp, Zea mays
  misc_feature: Ceres CLONE 1626762
  misc_feature: Encodes the peptide sequence at SEQ ID NO. 96362
atagtatatataagtatacactcttctaggatcggtcgtgaggagttccttaacatttcttgcgacatggagtacaaaaagagggtggatgcgctagtgtttttctctttacttctcctaggatactttgctgctcatgcgcatgggaacggtcatgtcacggatgatgtcaatgtttctgctccagctgaagaaggaattttgcgagaaaaaagagcacaatgcgctcaagggtttcttccatgcaaagataacaagtgctactgttgcattgggggccgaactcatgattgctactatacgatggctcagtgtagtcatgcatgcttctaatcaaaaattaagatcactgtttttatatacaatgtaatggtaggcaatgctattaataatacataagggaattttagaaaaaaaaaaaaaaaaaaaa

SEQ ID NO: 96362 - protein, 88 aa, Zea mays
  misc_feature: Ceres CLONE 1626762
MEYKKRVDALVFFSLLLLGYFAAHAHGNGHVTDDVNVSAPAEEGILREKRAQCAQGFLPCKDNKCYCCIGGRTHDCYYTMAQCSHACF

SEQ ID NO: 96363 - DNA, 1924 bp, Zea mays
  misc_feature: Ceres CLONE 1627582
  misc_feature: Encodes the peptide sequence at SEQ ID NO. 96364
aaagcatgcaagtaatatatcacgctttcagctcctctgcttacggtgccagaccgaccgagcaagatccattgatcgatatggagctgcttcctctgctcacgtggctcctccttgcgcacgccatggcctacctggcctggatggccgccgcgcgccgccggcagtcgcggtgctacctcctggactacgtgtgccacaagccccgcgaagaccgcaagctgtccacggaggcggccggcgccgtgatccagcgcaacgcgcggctggggctgacagactaccgcttcctcctccgcgtcatcgtccgctccggcatcggcgaggagacctacgccccgcgcaacatcctggagggccgcgaggactcgcccacgttgcgggacgcggtggacgagatggacgccttcttcgacgaggccatcgccgagctcttcgcccggaccgacgtcgcgccccgcgacgttgacgtgctcgtcttcaacgtctccatgctctccccggcgccgtccctgtcgtccaggatcgcgcgccgctacggcctgcgcgaggacgtggcggcgtacaacctcacggggatggggtgcagcgcggggctgatcgcgctggacctggcccggaacgcgctgcggacgcgcccccgcgcgctggcgctcgtggtgtcgtccgagtccatcgcgcccaactggtactccggcaccgacaagtccatgatgctggccaactgcctgttccgcagcggcggctccgcggtgctggtcactaacgacccggcccgccgcgggcgcgccaagatggagctcagctgcctcgtgcgcgccaacatcggcgccagcgacgacgcgcacacgtgcgcgcagcagcgcgaggacgccgagggccgcgtcgggatcagcctcagcaaggcgctccccaaggccgccgtgcgcgccttcgccgtcaacttgcgccgcctcgcgccgcgcgtgctccccgtcgccgagctcgcgcggttcgccgcgcgcctcctcgcccggaggctcttcccgcacctgcagcagcactcgtcgtccggcaagcacaagggcgacactgcggccccgcccaagatcaacttcaaggccggggtggaccacttctgcctccaccccggcggcacggccgtcatcgaggcggtgaagcagagcctgggcctggaggacgaggacgtggaggcggcgcggatgacgctgcaccggtggggtaacacgtcggcgagcagcctgtggtacgtgctgtcgtacatggaggccaagcgccggctcaaggtcggggacagggtgctcatggtcacgttcgggtccgggttcaagtgcaacagctgcgtctgggaggtcaccggcgacatggccgacgacaggggagcatgggccgactgcatccacgcctatccgccggagaggctcgccaacccctacatggacaagttcggatggatcaacaacgtcgacggcgacaccctcatgttctaacggtacagtacgctcacgatcgagcactatttcgtacagtcgtacaagtgatggtacatatacatgctactgcatggcggaaccggtcaaccggacatgacgacaacggaagcagcaggttgttcagaacgacagacaggtgatgcatacgtgttagctaatgcgtactgtacgtacgtgtatctatttaccccccgaacaatcgaacatattctttcttttgattattttctaccgcaaatgaaaaatatagttttactttttttctagaacagaggaaccatgtattttatattgtctttgaccttatcttgtctgcctgttaaatgatgttgacatgttgtccctgtccattcataaatgtttgcaaaaaaatcaagtgtaatcccccctaactttaaggaagatgatattatcaaaaaaaaaaaaaaaaa

SEQ ID NO: 96364 - protein, 494 aa, Zea mays
  misc_feature: Ceres CLONE 1627582
  misc_feature (48)..(339): Pfam Name: FAE1_CUT1_RppA Pfam Description: FAE1/Type III polyketide synthase-like protein
  misc_feature (362)..(450): Pfam Name: ACP_syn_III_C Pfam Description: 3-Oxoacyl-[acyl-carrier-protein (ACP)] synthase III C terminal
  misc_feature: SWISSPROT Homolog: EC 2.3.1.119 Icosanoyl-CoA synthase
MQVIYHAFSSSAYGARPTEQDPLIDMELLPLLTWLLLAHAMAYLAWMAAARRRQSRCYLLDYVCHKPREDRKLSTEAAGAVIQRNARLGLTDYRFLLRVIVRSGIGEETYAPRNILEGREDSPTLRDAVDEMDAFFDEAIAELFARTDVAPRDVDVLVFNVSMLSPAPSLSSRIARRYGLREDVAAYNLTGMGCSAGLIALDLARNALRTRPRALALVVSSESIAPNWYSGTDKSMMLANCLFRSGGSAVLVTNDPARRGRAKMELSCLVRANIGASDDAHTCAQQREDAEGRVGISLSKALPKAAVRAFAVNLRRLAPRVLPVAELARFAARLLARRLFPHLQQHSSSGKHKGDTAAPPKINFKAGVDHFCLHPGGTAVIEAVKQSLGLEDEDVEAARMTLHRWGNTSASSLWYVLSYMEAKRRLKVGDRVLMVTFGSGFKCNSCVWEVTGDMADDRGAWADCIHAYPPERLANPYMDKFGWINNVDGDTLMF

SEQ ID NO: 96365 - DNA, 361 bp, Zea mays
  misc_feature: Ceres CLONE 1628724
  misc_feature: Encodes the peptide sequence at SEQ ID NO. 96366
atccattggacgcagtccgtgagtgaaaatgagccatagccatagcactaagacatcgtggccggaggtggaggggatgcctgctgaggtggcgaagcgcaagatccaggaggaccgcccggacatccaggtgatccttgtgcctgtcgactccgccgtgaccgatgacttcaacaccaagcgcgtccgcgtcttcttcgacaaggccggcaacgtggcacaagtccccaagatcggctagggcaaatagtgtcgttacttcagttctatccagtcgaagctcatcttagttgtatgcggtgttatatacagtattatgcactcgtattttaactttcataaaaaaaaaaaaaaaaaaaaa

SEQ ID NO: 96366 - protein, 70 aa, Zea mays
  misc_feature: Ceres CLONE 1628724
  misc_feature (8)..(70): Pfam Name: potato_inhibit Pfam Description: Potato inhibitor I family
MSHSHSTKTSWPEVEGMPAEVAKRKIQEDRPDIQVILVPVDSAVTDDFNTKRVRVFFDKAGNVAQVPKIG

SEQ ID NO: 96367 - DNA, 2672 bp, Zea mays
  misc_feature: Ceres CLONE 1629889
  misc_feature: Encodes the peptide sequence at SEQ ID NO. 96368
gtgcgcctctgcaatcctctgtctctctttcctctgacttcgctgcctcctcgtccgtctcgcccggtcctctcactcgaagactctcgcttcgcttccaagttcaccccaatggcgacgcaaccgcttacatcaccgcgcgcttgagcgagagaccgatagcccccaccaaccgcgcgccttcgcggagcatggcggcgccggggctggacaaggtcatggcgttcctcaccgaccacggcttcgccggcgcggcctccgcgcttcgtgacgacgtccttgaacgcaccgccgccggggacgaaagccacgacgccgcattagatccccacctcccgccgctccggatgcccgcctccgccggcggtgccggtgccggtgccggtgccggcgctggcgctggcacgccgacgcccgcgagccccggttccagctccggttcggcgtcctcatcagctttcgtaagcttgcgctccacaccctcagggctgttgaatccgtatggactatggtcgccgcggcattcgcagtcggacgcgtcttcatcggagatggagtttggtacagcgcgccagtacgacaccaccgacctcttcttccaagaggattggctctacgacgatcacctcttccctagcaagctggacgatgaggatgacgaaggcaaagaggaggacaaatttgtactggatgctcacgatggttcggagcaggttgaaataggcaagcttggtgcaggccataaccaccgtcacgaacacatcggtggtgaccgatgcgagggttgtgctgaggtgtacatatgctcatcgccactctgtggttgttgtggagggggactcaagaatgatgggcttgatgtggccaggagctcaagctccactgtgtatgggagatacaagatcatggatgaccagacagagatattggatgattgtgcgcaggatgcgtttcagttgaagcagagtagagatattatgtttgaatgcggtatgacgagggatcctggacgaggatatgatgattcagggctgagtgttgtggagaaggagcttcaaatactcagttcatttgatactgttgtgaatcacggtacatatgatttcacggaaaatggtgagctcaatggcagctgtgacaaaaatctgaaaagcagcattcataaagaatatccgaaaggtcataggatacagccattccctgaaagtggtgatcttgatgaagctgatgagtttcgacatgttggatcattaaatacagatgttcaacattctactgctcttaaagctgaggaagatgccgagacaaatattgatcttgctctctctgattttcaccgagaatatgaggtatttgaattgagaattatccaccgcaagaacaggactggatttgaagaaaacaaagatttccccatcgtcttaaattcggttgttgctggaaggtattatatcactgaatatctaggctcagctgcattcagcaaggttgtgcaagcacatgatcttcgtacaggaatggatgtttgccttaaaataattaaaaatgataaggacttcttcgaccagagcttggatgagataaaacttctgaagttcgtgaacaaatatgatccactagatgaacaccatgtgttgcgcctctatgactacttttaccatcaggaacacctttttattgtcactgaactactgcgagcaaatctatacgagtttcagaaatataatcaagaatctggtggtgaggtgtattttactttgcctaggatacaggttatagctcggcaatgtttggaggccttggtttacttgcaccgtctgaggatcattcattgtgacctaaagccagaaaatattcttatcaagagctacagtagatgtgaaattaaagtcattgatctgggaagtagttgcttcttgacagacaacttatgtctctatgtccaatcacgctcttatcgagctcctgaggtcattctaggcctaccttatgatcagaggattgatatttggtctcttggttgcatcctttctgaattgtatactggtgaagtattatttcctaacgagcctgtgtccgtaatgcttgctcaaatgattgggataaccggcccaattgacatggaaatgctagaattgggacaggagacacagaagtatttcactgatgattatgacctttttaccgagaatgaggagacagatcagctagagtatttgatcccggagaaatcctccttgcgacaacacatacaatgtcctgattcagagtttgtcgattttctgtcttatctactgcaaattaaccccaggaaaagacctacagctgacgaagcactacagcatccatggctttctttctcgtactaatgagaagccatccggtgctttcttcacatataaagaatagccctccttttctgggtgcaggattcttctttttttgtgtcttcagggtaattcttgcgtttcctttttctgggtccaggattcttttttttttgtcttcagggtaattcttggtgtgaagtgtgaacccctgccctggagtgattcatgagtgtatgtaaatatcagaaaattttccgcggagtaactgtacagttgtaagcccactcttgtactcctgatcatgaatgataacatgggaatttctaaaaaaaaaaaaaaaaa

SEQ ID NO: 96368 - protein, 725 aa, Zea mays
  misc_feature: Ceres CLONE 1629889
  misc_feature (419)..(721): Pfam Name: Pkinase Pfam Description: Protein kinase domain
  misc_feature: SWISSPROT Homolog: EC 2.7.12.1 Dual-specificity kinase
MAAPGLDKVMAFLTDHGFAGAASALRDDVLERTAAGDESHDAALDPHLPPLRMPASAGGAGAGAGAGAGAGTPTPASPGSSSGSASSSAFVSLRSTPSGLLNPYGLWSPRHSQSDASSSEMEFGTARQYDTTDLFFQEDWLYDDHLFPSKLDDEDDEGKEEDKFVLDAHDGSEQVEIGKLGAGHNHRHEHIGGDRCEGCAEVYICSSPLCGCCGGGLKNDGLDVARSSSSTVYGRYKIMDDQTEILDDCAQDAFQLKQSRDIMFECGMTRDPGRGYDDSGLSVVEKELQILSSFDTVVNHGTYDFTENGELNGSCDKNLKSSIHKEYPKGHRIQPFPESGDLDEADEFRHVGSLNTDVQHSTALKAEEDAETNIDLALSDFHREYEVFELRIIHRKNRTGFEENKDFPIVLNSVVAGRYYITEYLGSAAFSKVVQAHDLRTGMDVCLKIIKNDKDFFDQSLDEIKLLKFVNKYDPLDEHHVLRLYDYFYHQEHLFIVTELLRANLYEFQKYNQESGGEVYFTLPRIQVIARQCLEALVYLHRLRIIHCDLKPENILIKSYSRCEIKVIDLGSSCFLTDNLCLYVQSRSYRAPEVILGLPYDQRIDIWSLGCILSELYTGEVLFPNEPVSVMLAQMIGITGPIDMEMLELGQETQKYFTDDYDLFTENEETDQLEYLIPEKSSLRQHIQCPDSEFVDFLSYLLQINPRKRPTADEALQHPWLSFSY

SEQ ID NO: 96369 - DNA, 958 bp, Zea mays
  misc_feature: Ceres CLONE 1632394
  misc_feature: Encodes the peptide sequence at SEQ ID NO. 96370
tgccaggcgtaggcaggggatccttccgtttatgcaatgggacacccaccgggcgctcctccactttgagaccaaagcaactgtagtattgggttgcatcaagtggctgaccagtgtagtgcgtcgattttgtttagttgtttcgttcgaattattattggccatttaccgaatctgttgagatacgcgctggactagtagattgtcgatggaactcagaacgcaaatagaaaccatctgtaatctgaaaaaaaaaaaaaaaaaaaactcgagttttttttttttttttttttgccatatatcaacatacgatccatcatattataaataaacaatacggtacaaacagatcgggctcccgaaatcgacaagttccaatgcctattataacggcaagtgcgacagcaggtaccgtcttccagcaccagtatgcctgctgcgttcggaagccaagccagcaacgaccgtcgaccatacatgacatccagataaaaccggattggtcgttttctccttattcttctccgctaagctcactcgaattcgagtgagcttagcggctccgccgcagcgatgccgtcgcacaagaccttccggatcaagaagaagctggcgaagaagatgcgccagaaccgccccatcccctactggatccgcatgcgcaccgacgacaccatcaggtacaacgccaagcgcaagcactggcgccgcaccaagctcggcttctgagcgcggggatcggccatctcccgcgtcggaattctagggtctctacctttcctttggttttatcgatgtctcttgtgtttctgtaagctagcaaacggttccagaaagcttttgttaagattttgatgacgctaagaggattgatgctactatgctgtactcaggattccatgctgcattgcgatgctaaattaaagaacctctgttacaaaaaaaaaaaaaaaaaaaa

SEQ ID NO: 96370 - protein, 51 aa, Zea mays
  misc_feature: Ceres CLONE 1632394
  misc_feature (9)..(51): Pfam Name: Ribosomal_L39 Pfam Description: Ribosomal L39 protein
MPSHKTFRIKKKLAKKMRQNRPIPYWIRMRTDDTIRYNAKRKHWRRTKLGF

SEQ ID NO: 96371 - DNA, 453 bp, Zea mays
  misc_feature: Ceres CLONE 1632439
  misc_feature: Encodes the peptide sequence at SEQ ID NO. 96372
gagctactttgttttgatttatcaggaaatccgtttgcttcatgttatgcaggctcagatctgattgctggattcggcatcttacgggcttgaatagagcaacccgcgttggatcctgtatcggttagtccttgcctgcaaggttcatgttgttttgttttggtggtcgagcatcgcatgttctgcttctggttccagatctggagaaatttctaagtcgtcgtcgtcgttcggttcggagcggatctgaggcgacgatggctggaggcggcgggatctcttggtctgcagtcctgctccaactcgatggatgatgtctctgcgctgataattattggatcaatttcgataattattagtagatctatgagatatgccgcctggaagaggcgaggtaagctgcagcatgtaaaagtctgcgtgcgtcgacaacaaaaaaaaaaaaaaaaaaaa

SEQ ID NO: 96372 - protein, 55 aa, Zea mays
  misc_feature: Ceres CLONE 1632439
MLFCFGGRASHVLLLVPDLEKFLSRRRRSVRSGSEATMAGGGGISWSAVLLQLDG

SEQ ID NO: 96373 - DNA, 605 bp, Zea mays
  misc_feature: Ceres CLONE 1632970
  misc_feature: Encodes the peptide sequence at SEQ ID NO. 96374
gcaacgattacggtaacgccgtcgccgccctacggctcagatcttcgtcgtcatcttctccggcaacgagcacccaaggatggtggtccttcaaccagatcggttcctgagcgagctgacgagcatgtacgagcggagcacggagaagggctccgtctgggtcaccatgaagcgatcaactctcaagggcaaggcacagttgcggaagatggagaataaggggcaggaggtagagcacaggtgcctcgtccgcgcctccaatggcaagaagaacatctccacctcggtttctctaaaggagtacacaaagttccaagcttcatacgcaacagttcttaaggcccatatgcatgctctgaagaaaagggagaggaaagacaagaagaaggctgcagatgctgagaaggcaattgagaccgcacccaagaagcagaagaaagcatcttcaaagaaatcttcggggtccaagtcataaggcgctcgcagaaatcagtgtcttctcccttctgttgttaccgcaccgccagactaattagagtgtcgtgaattttatctggtttttatccgaatgtgtgtctgggagacaaaaaaaaaaaaaaaaaaaa

SEQ ID NO: 96374 - protein, 131 aa, Zea mays; identical to SEQ ID NO: 43322
  misc_feature: Ceres CLONE 1632970
  misc_feature (4)..(93): Pfam Name: SRP14 Pfam Description: Signal recognition particle 14kD protein

SEQ ID NO: 96375 - DNA, 1033 bp, Zea mays
  misc_feature: Ceres CLONE 1633828
  misc_feature: Encodes the peptide sequence at SEQ ID NO. 96376
acaatcaccagcgcacagcactcctcatcgtcacacccgagctcgccctctccttcctcatcgaggcccgagtcctgctttgatggcgaccgacgttgctgagactcccgcgccgctggtggatgcggcccctgaggcgcccgcggacaccccggcggcgcctgctgttgacgcgaagccggccaaggccaagaaggccacagcgccgaagaagcgcgccagcccgacccatccgccgtacgccgagatggtctcggaggcgatcgcgtcgctcaaggagaggacggggtccagcagctttgctattgccaagttcttggaggacaagcacaaggacaagctcccgcccaacttccgcaagcttctgaacgttcagctcaagaagctcgtcgccggcggcaagctgaccaaggtgaagaactcgtacaagctgtcgtccgccaccaagccaaaggccgccccgaagaagaccaagaccggcgtgaagaagcccaaggccgctgccaaaccgaaggccgagtcccccgcgaagcccaagcccgccacaaagcccaaggcggccgcgaagcccgcttccaagccgaaagcagcagcaaaacccaagcccaagcttcctgccaaggcgaagcccaagtctgccggcgctaagccgaagccagccgccaagaaggccggccgccccgccaaggcggccaagacgtcggccaaggccacgccaggaaagaaggcgccggtgaccaagaagcccgcggccgccgcggagaaggcgccggtggccaagaagcccgttccggcgaagaaggcggctgcccctgcccgaaaagcgccggcacggaaggcgaagaagtagaggggtaggcggcggagaaatgtagggtttggttctcgtatgacgctagatgtttgctctccctttagcctaggtggtgtctgtgtgtgcaatgttgtaaatttgatatcggatgctgggaacactaagtcaatctttcaaaaaaaaaaaaaaaaaaaaaaacaaaaaaaaaaaaaaaaaaaa

SEQ ID NO: 96376 - protein, 255 aa, Zea mays
  misc_feature: Ceres CLONE 1633828
  misc_feature (49)..(119): Pfam Name: Linker_histone Pfam Description: linker histone H1 and H5 family
MATDVAETPAPLVDAAPEAPADTPAAPAVDAKPAKAKKATAPKKRASPTHPPYAEMVSEAIASLKERTGSSSFAIAKFLEDKHKDKLPPNFRKLLNVQLKKLVAGGKLTKVKNSYKLSSATKPKAAPKKTKTGVKKPKAAAKPKAESPAKPKPATKPKAAAKPASKPKAAAKPKPKLPAKAKPKSAGAKPKPAAKKAGRPAKAAKTSAKATPGKKAPVTKKPAAAAEKAPVAKKPVPAKKAAAPARKAPARKAKK

SEQ ID NO: 96377 - DNA, 741 bp, Zea mays
  misc_feature: Ceres CLONE 1634246
  misc_feature: Encodes the peptide sequence at SEQ ID NO. 96378
gaaccctagcgccgcaccctcccgcccaccgccgtcgccgcccaaccgcagtaaggaggaaggagcaggaagatgccggcggggcacgggctgcggtcgcggacccgcgacctgttcgcgcggcccttccgcaagaaggggtacatcccactcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccatcggcgtcgagatcaacaagcaggttaatggccgcatcatcaggaagcggatccatgtccgcgtggagcatgtgcagccctcccgttgcacggaggagttccgcttgaggaaagccaagagtgaccagctcaaggcggatgccaaggcccgcggtgaggtgatcagcaccaagaggcagcctgtgggacccaaacctggcttcatggttgagggtgctacactcgagacagtcactcctattccttatgatgtggtcaacgatctcaagggcggttactagagagaatttttgtaccttcagcagttcaaacgagctggcaaacttatctgaatctttttgataattggctagttcttctggtcctggtgtttatgaactcatggtggctatttgctgttggccgtcaaaaagattttttttttattggccaaaaaaaaaaaaaaaaaaaaaaaa

SEQ ID NO: 96378 - protein, 164 aa, Zea mays
  misc_feature: Ceres CLONE 1634246
  misc_feature (2)..(100): Pfam Name: Ribosomal_L21e Pfam Description: Ribosomal protein L21e
MPAGHGLRSRTRDLFARPFRKKGYIPLTTYLRTYKIGDYVDVKVNGAVHKGMPHKFYHGRTGSVWNVTKRAIGVEINKQVNGRIIRKRIHVRVEHVQPSRCTEEFRLRKAKSDQLKADAKARGEVISTKRQPVGPKPGFMVEGATLETVTPIPYDVVNDLKGGY

SEQ ID NO: 96379 - DNA, 2228 bp, Zea mays
  misc_feature: Ceres CLONE 1636202
  misc_feature: Encodes the peptide sequence at SEQ ID NO. 96380
aatccacactgagctgcccaaatccacattcccatcggcgcagacggccgggaggaggatgtccatgccggagacgttcaccctgaaggtgggggaggcgacgccggccgccgccggcaggccgtcggccgggcccgtgtaccggagcatctacgccaaggacggcctcatggacctcccacaggacatccagtccccttgggacttgttcagtggggcagtcaagaagtaccccacgaacaggatggtcgggcagcgtcaggttacagatggcaaggccggtgagtatgtgtggcaaacgtacgaggaagtgtgccagaaggtcatgaggattggatcagcgatcagaagcctgggcgtagagccgggagctcactgtggcatatatggatccaactgcccggaatgggttatggccatgcaggcatgtaacagtcaagggatatgttatgtgccactgtatgacaccctcggagctaaagctgttgaattcatcatgtaccatgctgagatatccattgcctttgtccaggagagcaagatcaaatcaatactagcagttctccctaagtgcacagcgcaccttagagccattgttagtttcggagattttgcaagcgagatgaaagcggaagctgagagattgggcgtctcctgcttttcttgggaagagttttcttcaatgggaaaacaagactaccaacttcccaataaacgtaaggaagatatctgtacaatcatgtataccagcggaacaactggagatcccaaaggtgtgataatcacaaacaaagctatcgttgctggtgttatgaccacagaacacctcctcaaagagaccgataaagtgatcacagaagaggattcctacttttcctaccttccattagcacatatatttgatcaagtaattgagaactactgtatttctaaaggagcctccatcggattctggcaaggggacattaggtacctgatggaggatgtgcaagtgatgaaaccgacaatattctgtggtgttcctcgtgtttatgatcgtatatatacaggtataaacatgaaaattcagtctggagggatgatagccagacacctttttcagtatgcctacaactacaaacttgccaatatgaggaaagggctgaaacagcatgaagcatcaccgtttttcgacaagatagttttcagcaaaataaaggaagggcttggagggcgtatacgtctcatgatagctggagcagcacctttgccagggcaaatcgaagaattcatgcgggtaaccacctgcagcgttgtagtacaaggatatgggctcactgagagttgtgcaggatgcttcacgtcaatcgccaacattttctcaatgattggaacagtcggccctcctgtcacaacaatagaagcacggctggagtcggtccctgaaatgggctacgacgcactgtcagacacgccccggggcgagatctgcttgaggggccacaccatgttctccgggtactacaagcgccctagcctcactgaagaagtgttctcagatggctggttccatacaggtgatatcggggagtggcaatccaatggcacgatgaagatcatcgacagaaagaagaacatcttcaagctgtcccagggggagtatgtggcagttgaggtcctggaaagagcatacctgcagtcaccccttgtggcatcggtctgggtctacgggaacagcttcgagtcgttcctcgttgccgtggctgtccctgagaggcaggctctcgaggaatgggcagcagccaacagcaaggccggcgactttgcagagctgtgcgctgatcccaaggcgaggacctacgttcgggatcagctgaaccaaactgggaagaaacttgggttgagaggcttcgagatgctgaaagcagtctacctggagccggtgcctttcagcatcgagaaggacctcgtcactccaacctttaagctcaagagaccccagctgctcaagtattacaaggatcgggtcgaccaaatgtacaaggatgccaaggaggggagagctgcgccatgagcccatgacggcattgccaatttgccacgagtggctatgatcctgagcattgtgattcctcgaaagcgtgtacatattgattatcacaatttgtaagtttaaggcatgtgtgttctatgccaaaatgtcagcagaaaatgaattggctaagaagctcgcgaaaaaaaaaaaaaaa

SEQ ID NO: 96380 - protein, 664 aa, Zea mays
  misc_feature: Ceres CLONE 1636202
  misc_feature (81)..(549): Pfam Name: AMP-binding Pfam Description: AMP-binding enzyme
  misc_feature: SWISSPROT Homolog: EC 6.2.1.3 Long-chain-fatty-acid--CoA ligase
MSMPETFTLKVGEATPAAAGRPSAGPVYRSIYAKDGLMDLPQDIQSPWDLFSGAVKKYPTNRMVGQRQVTDGKAGEYVWQTYEEVCQKVMRIGSAIRSLGVEPGAHCGIYGSNCPEWVMAMQACNSQGICYVPLYDTLGAKAVEFIMYHAEISIAFVQESKIKSILAVLPKCTAHLRAIVSFGDFASEMKAEAERLGVSCFSWEEFSSMGKQDYQLPNKRKEDICTIMYTSGTTGDPKGVIITNKAIVAGVMTTEHLLKETDKVITEEDSYFSYLPLAHIFDQVIENYCISKGASIGFWQGDIRYLMEDVQVMKPTIFCGVPRVYDRIYTGINMKIQSGGMIARHLFQYAYNYKLANMRKGLKQHEASPFFDKIVFSKIKEGLGGRIRLMIAGAAPLPGQIEEFMRVTTCSVVVQGYGLTESCAGCFTSIANIFSMIGTVGPPVTTIEARLESVPEMGYDALSDTPRGEICLRGHTMFSGYYKRPSLTEEVFSDGWFHTGDIGEWQSNGTMKIIDRKKNIFKLSQGEYVAVEVLERAYLQSPLVASVWVYGNSFESFLVAVAVPERQALEEWAAANSKAGDFAELCADPKARTYVRDQLNQTGKKLGLRGFEMLKAVYLEPVPFSIEKDLVTPTFKLKRPQLLKYYKDRVDQMYKDAKEGRAAP

SEQ ID NO: 96381 - DNA, 2383 bp, Zea mays
  misc_feature: Ceres CLONE 1636204
  misc_feature: Encodes the peptide sequence at SEQ ID NO. 96382
aaacactcaaggccacaaaccaaatgctgctaactactccagctagctagcaacaataatggcggcctgccgtccctccggcctcagcgtcttgtgcagcctctaccgtctctacatctgcatgctgttcatccatgtccctcgggctcactcgctgtccttcgacctcagcttctccaaaccccagagcccagacctctcctcccagaagataaacttcaacggcgacgcgtaccccactccagaaacgctcgagctgacgcgaaaccagcatgaccaaagcagcaccaacagcatcggccgggcgacgtacgcgcagccggtgccgctgtgggatggcgccaccggcgagacggccagcttcaccaccaccttcaccttccggatcaggccggactcgtggagcccgtaccccggcgacgggatggcgttcttcctcggccactacgggtcagatatccccgtccagagcggcggcggcatgctcggcctcgtcccgacccacaccaacggcaccggaaacggcaccgtcgtcgccgtcgagttcgacaccttccagaacccgacgaacgacgacatcagcagcaaccacgtgggcatcgacgtcgactccctcaactccacggcgtccacggacaccacctcgccgaccaagaacctcacgtccggttacctgatggcggccaccgtaaggtacgagaacgtcaccaggttgctcgccttggagctcaccgtcaacgacacgtcctactacgtcaacgcaactgtcgatctcaagggctacctaccggagcgtgtagccgtcggcttctccgcggcgactggaaatggcggcgagcagcaccaggtgctgtcatggtcattcacgtccactctgccggaaccaccggcaccggcaccggcaccgccgccgcatgcgacaccagacaacaaccagcctcccaagaagaagagatcagtcgggaccacgggcctgataatcgccgtgcttgtgcctctgctatctctcctggcgtgtgcggcaggcgtgctggcaaggcgaaaactcaggggaagaagaagaagaagaccgccaaacggtagcagcgacgacgacaacgattaccaagaacaggacaacggcagcagggcggagctcgagagaggagtggctgccaccggcccccggcggtacgcgtaccgcgacctggccgccgccaccgacaacttcgccgaggacggcaagctcggtcgcggtggcttcgggagcgtctacaggggcaaactcaccgtcgccggcgaagagcggcccgtggcgatcaaggtgttgtcgtcggagtcgtcggcgcagggcaggaaggagttcgaggcggaggtgaggatcatcagccggctcaagcatcgcaacctcgtgcagctcctgggctggtgcgacagccggcacggcctcctgctcgtctacgagctggtggcccagggcagcctcgacaggcatctccacggcagcgagcgcttcttggcgtggccggacaggcaccagatcatcctcggcctggggtcggcgctgcggtacctccaccaggagtgggagcagcgcgtggtgcacggcgacatcaagcccagcaacatcatgctggacgactcgctgggcgccaagctcggcgacttcggcctggcccggctcggagaccacggcgggcgctggcacaccaccaaggccgtgctcggcaccgcggggtacatcgacccggagttcgtcaacacgcgccacccgagcacccacgccgacgtgtacagcttcggcatcgtcctcctcgaggtcgtctccggccggtccccggtggtcctgctgcccggcgagccgcccttcgttctgctcaagtgggtgtggggcctgtacggacggaacgcggtcctcgacgcggcggacgagcagctgaggggcggcggcgacgacgacgagtgcatcgagagggcactcgtcgtcgggctctggtgcgcccaccctgagcagagcgagcggccgtccatcgcgcaggccatgcacgtcctgcagtcggcggacgccaggctgccggcgctcccgccgcagatgtacaagacggcgtcggacctcgccgtcaccggacgttcctacggcgttttgtccgtggaaagctacagcggcggtgactcctctacgacgactacgaccgccggctactccaaaacttcttcaggctcgtcgaccacggccttgctccgagattcaaaagagagaccttgattctgcaaaaataaaataaaaaatcctatgtgggagctgaactgtaaaaaaaatgtgttttcagttttgttaatttgggctgaagcctgaagctaacactttcagttttgaatcttccttcaaaaaaaaaaaaaaaaa

SEQ ID NO: 96382 - protein, 728 aa, Zea mays
  misc_feature: Ceres CLONE 1636204
  misc_feature (29)..(270): Pfam Name: Lectin_legB Pfam Description: Legume lectin domain
  misc_feature (384)..(658): Pfam Name: Pkinase Pfam Description: Protein kinase domain
  misc_feature: SWISSPROT Homolog: EC 2.7.11.1 Non-specific serine/threonine protein kinase
MAACRPSGLSVLCSLYRLYICMLFIHVPRAHSLSFDLSFSKPQSPDLSSQKINFNGDAYPTPETLELTRNQHDQSSTNSIGRATYAQPVPLWDGATGETASFTTTFTFRIRPDSWSPYPGDGMAFFLGHYGSDIPVQSGGGMLGLVPTHTNGTGNGTVVAVEFDTFQNPTNDDISSNHVGIDVDSLNSTASTDTTSPTKNLTSGYLMAATVRYENVTRLLALELTVNDTSYYVNATVDLKGYLPERVAVGFSAATGNGGEQHQVLSWSFTSTLPEPPAPAPAPPPHATPDNNQPPKKKRSVGTTGLIIAVLVPLLSLLACAAGVLARRKLRGRRRRRPPNGSSDDDNDYQEQDNGSRAELERGVAATGPRRYAYRDLAAATDNFAEDGKLGRGGFGSVYRGKLTVAGEERPVAIKVLSSESSAQGRKEFEAEVRIISRLKHRNLVQLLGWCDSRHGLLLVYELVAQGSLDRHLHGSERFLAWPDRHQIILGLGSALRYLHQEWEQRVVHGDIKPSNIMLDDSLGAKLGDFGLARLGDHGGRWHTTKAVLGTAGYIDPEFVNTRHPSTHADVYSFGIVLLEVVSGRSPVVLLPGEPPFVLLKWVWGLYGRNAVLDAADEQLRGGGDDDECIERALVVGLWCAHPEQSERPSIAQAMHVLQSADARLPALPPQMYKTASDLAVTGRSYGVLSVESYSGGDSSTTTTTAGYSKTSSGSSTTALLRDSKERP

SEQ ID NO: 96383 - DNA, 2478 bp, Zea mays
  misc_feature: Ceres CLONE 1638153
  misc_feature: Encodes the peptide sequence at SEQ ID NO. 96384
agcaagaatccagcgagccaacaaggcaacaacaaacacctccctccttcttcacttccctgccgttgttgcaggaagcaagcgagggcacacaaaccgacaaggccgcccacgcgcgcgtcggccgccgccgttgccgaccagcaggcaggcagcatggtcgtgaacaacaaggtggacagcctgtcgtacgacgtcgaggcgccgccgccctctgccgccggcgccgccgcggggcaagcgccaccgccggcgtcgccagctccggcgccggcaccggcaacccacgcgcccgtgacgcgggaaggcggcgcggcgtcggtgctggagctgcacaaggtgtcgctgccggagcggcggacgacggcgaaggcgctgcggcagcgcctggccgaggtgttcttcccggacgacccgctgcaccagttcaagaaccagtcgtcggcgcggcgcctcgtgctggcgctgcactacttcttccccatcttccagtgggggtccgcctacagcccgcgcctcctgcgctccgacctcgtcgccggcctcaccattgccagcctcgccatcccgcagggaatcagctacgccaagctcgccaacctgccgccaatcgttggcctatattccagcttcgtgccgccgctcatctacgcgctgctggggagctcgcgggacctggcggtggggccggtgtccatcgcgtcgctggtgatggggtccatgctccgggacgccgtgtcgccggacgagcagccgctcctctacctgcagctggccttcaccgccaccttcttcgccggcgtcttccaggcgtccctgggattcctcaggctgggcttcatcgtggacttcctgtccaaggcgacgctgacgggcttcatgggcggcgccgccgtcatcgtgtcgctgcagcagctcaagggcctgctcggcatctcccacttcacctcccacatgggattcctcgacgtcatgcgctccgtcgtcaaccgccacgacgagtggaagtggcagacgatcgtcatgggctccgccttcctcgccatcctcctcctcacgcgccaaatcagcgccaggaacccaaagcttttctgggtatcagcaggtgctcccctggcgtcggtgatcatctccaccatcctctccttcatctggaaatcccccagcatcagtgttattggcatcctccccaggggagtgaaccctccttcggcgaacatgctcagcttcagcggctcctatgtggcgctgacgatcaaaaccgggatcatgacaggcatcctgtccttaacagaagggatcgcagtgggcaggaccttcgcgtccatcaacaactaccaggtggacgggaacaaggagatgatggcgatcgggctgatgaacatggcgggctcctgcgcctcctgctacgtgacgacggggtccttctcccggtcggcggtgaactacagcgcgggctgcaggacggcgctgtccaacgtcgtgatggcggcggcggtgctggtgacgctgctgttcctcatgccgctgttccactacaccccgaacgtgatcctggcggcgatcatcatcacggcggtggtggggctggtggacgtgcgcggcgccgccaggctgtggaaggtggacaagctggacttcctggcgtgcgtggcggcgttcctcggcgtgctgctggtgtccgtgcagacgggcctgggcgtcgccgtcggcatctcgctcttcaaggtcctgctgcaggtcacccgccccaacgtcgtggtggagggcctcgtcccggggacgcagagctaccgcagcgtggcgcagtaccgcgaggccgtccgcgtgccgggcttcctcgtcgtcggcgtcgagtccgccgtctacttcgccaactccatgtacctggtggagcgggtcatgcgctacctccgcgacgaggaggagcgcgcgctcaagtccaaccacccctccatccgatgcgtcgtcctcgacatgggcgccgtcgcggcgatcgacacgagcggtctagacgcgctgtccgagctcaagaaagtcctggacaaaagaaacatcgagctggtgcttgccaacccggtggggtcggtggcggagaggatgttcaactcggcggtgggcgagagcttcgggtcgggccgcctcttcttcagcgtagcggaggccgtcgcggcgggggcgtgcaaagcggcgcagccctgacgacgacgacaggctgatccctgaggtgccgcacgggagcatgcataggaataggatgggtcagagacagactaccggtgctgctagtggtagtagggcaggacgacgtacgaataacatggtgatggcctctcttcctccactccgatgcgatgcgatgcgtgcgacgcaggggaggggagaagagtttttgaaggatgtgaccagttgctgttgtagttgttgtcaagtacgtagtaatgaaacgagaattgctgcgtggcaaaaaaaaaaaaa

SEQ ID NO: 96384 - protein, 681 aa, Zea mays
  misc_feature: Ceres CLONE 1638153
  misc_feature (221)..(529): Pfam Name: Sulfate_transp Pfam Description: Sulfate transporter family
  misc_feature (552)..(670): Pfam Name: STAS Pfam Description: STAS domain
MVVNNKVDSLSYDVEAPPPSAAGAAAGQAPPPASPAPAPAPATHAPVTREGGAASVLELHKVSLPERRTTAKALRQRLAEVFFPDDPLHQFKNQSSARRLVLALHYFFPIFQWGSAYSPRLLRSDLVAGLTIASLAIPQGISYAKLANLPPIVGLYSSFVPPLIYALLGSSRDLAVGPVSIASLVMGSMLRDAVSPDEQPLLYLQLAFTATFFAGVFQASLGFLRLGFIVDFLSKATLTGFMGGAAVIVSLQQLKGLLGISHFTSHMGFLDVMRSVVNRHDEWKWQTIVMGSAFLAILLLTRQISARNPKLFWVSAGAPLASVIISTILSFIWKSPSISVIGILPRGVNPPSANMLSFSGSYVALTIKTGIMTGILSLTEGIAVGRTFASINNYQVDGNKEMMAIGLMNMAGSCASCYVTTGSFSRSAVNYSAGCRTALSNVVMAAAVLVTLLFLMPLFHYTPNVILAAIIITAVVGLVDVRGAARLWKVDKLDFLACVAAFLGVLLVSVQTGLGVAVGISLFKVLLQVTRPNVVVEGLVPGTQSYRSVAQYREAVRVPGFLVVGVESAVYFANSMYLVERVMRYLRDEEERALKSNHPSIRCVVLDMGAVAAIDTSGLDALSELKKVLDKRNIELVLANPVGSVAERMFNSAVGESFGSGRLFFSVAEAVAAGACKAAQP

SEQ ID NO: 96385 - DNA, 1994 bp, Zea mays
  misc_feature: Ceres CLONE 1638462
  misc_feature: Encodes the peptide sequence at SEQ ID NO. 96386
cctagaaaaactgttccggcaggcagccgctcccgctcccgctcccccaccccactccccctcgcgcggcgcgttctcagatcccccgcccggttggcaccggcaccccggtccgaaatgcaaggagccttgtagcgcctcggagcacggacggaatcgcgccgcatgcatcccaagcccgagggcggcggcgacgacgacggggccgccgcggaggtgggctccccgcggtccggctacttccggcagcggagcatgcacgccgccgccgccgccgcggatccggaggcggcgcgccggccgttccacgtcgagaacccgccttgctccgccggcggggggctgcggcccagcgagtccgtcaccaagctggagtcgctggagcgtgccgcgctggcgcccgccgtggtgctcaggaccgggttctacatcctggtgtggtacgcgttcagcacctgcctcacgctatataacaagacgctgctgggggataagctcggcaagttcccggcgccgctgctgatgaacaccgtgcacttcgcgctgcaggcggggctctccaagctcatcatctggttccagcccaaggggcccgaggccgccgtcgacatggggtggaaggactacttcatgagagtcgtgccaactgctctcgggacggccttggacataaacctgagcaacgcgtctctggtgttcatctcggtgacgtttgctactatgtgtaaatcagcctccccgatattcttgttgctctttgcttttgcatttaggttggagaatcctagcatcaagcttctaggaattatagttgttatttctactggagttctgttgacagtttccaaggagacggagtttgacttctggggcttcatttttgtgacgcttgctgctgttatgtcaggattccggtggtccatgactcagattctgttgcagaaagacaattacggcctgaagaatccgattaccttgatgagccatgttacaccagtgatggccatcgccactatgatactatctctattactggatccttggagtgaatttcaaaagaattcatattttgatagcccttggcatgtcatgcgcagttgcttacttatgcttatcggaggatccttagcttttttcatggtgttaacagagtatatacttatttcagcaacaagtgccataaccgtgacgatagctggggtagtaaaagaagctgtaaccattttggttgcggtattttatttccatgatgaatttacttggttgaaagggtttggtcttttcaccattatggttggtgttagcttgttcaattggtacaagtatgagagattcaaaaggggtcagataaatgaggatgacgtcagctctccatttactggtgacgtcaagtacattattatagacgacttggaatatcagaatgaatttgaggaagatacataattctgtaatacagtgaattctaactgccactggcttgttcatgcctgaacctattgaaatagtagttacttatcgaggttttctccggaaaacatgcacgaagaacacagctaaggctaggtgtgattatactatgcacaccaaaatctgatgtgagctatgtttgtcacgatggatgttcaattctcgtcttggttgaacagccaggctgactacactgtcaagcaaagagctaactccatcggatcagaattcccattttgagaagactagcagtgggttgcatattgatatacatgcttatagcgggaactgctgagaatgctccggcatctgtatatttgttgttctcttcgcgttagtgcgctgggcgcatattcattcttgaacctccacatttttagtgacgaggtgtattcattctctatataggtctgttttgtaaatgtgaccagaggataccatacacgtgctgttttcccttgaaacctagggagcggcatttattttttctgtagactgtttcggggtaaaaaaaaaaaaaaaaa

SEQ ID NO: 96386 - protein, 426 aa, Zea mays
  misc_feature: Ceres CLONE 1638462
  misc_feature (236)..(384): Pfam Name: TPT Pfam Description: Triose-phosphate Transporter family
MHPKPEGGGDDDGAAAEVGSPRSGYFRQRSMHAAAAAADPEAARRPFHVENPPCSAGGGLRPSESVTKLESLERAALAPAVVLRTGFYILVWYAFSTCLTLYNKTLLGDKLGKFPAPLLMNTVHFALQAGLSKLIIWFQPKGPEAAVDMGWKDYFMRVVPTALGTALDINLSNASLVFISVTFATMCKSASPIFLLLFAFAFRLENPSIKLLGIIVVISTGVLLTVSKETEFDFWGFIFVTLAAVMSGFRWSMTQILLQKDNYGLKNPITLMSHVTPVMAIATMILSLLLDPWSEFQKNSYFDSPWHVMRSCLLMLIGGSLAFFMVLTEYILISATSAITVTIAGVVKEAVTILVAVFYFHDEFTWLKGFGLFTIMVGVSLFNWYKYERFKRGQINEDDVSSPFTGDVKYIIIDDLEYQNEFEEDT

SEQ ID NO: 96387 - DNA, 916 bp, Zea mays
  misc_feature: Ceres CLONE 1638687
  misc_feature: Encodes the peptide sequence at SEQ ID NO. 96388
agtcacacaccacaggctgtgtagagcgcgcgcctggcatgacgatggctcgttctggggcggctttgccgctgctgctggtcgtggtcggcgcttgctgcgcgcgcctggcggcggcagtgcacctctccgcgctcggcaggacactcatcgtcgaggcgtcgccgaaggccggacaagtcctgcacgccggcgaggacacgataaccgtgacatggcacctcaacgcgtcggcgtccagcgtcgggtacaaggcgctggaggtgaccctctgctacgcgccggcgagccaggaggaccgcgggtggcgcaaggccaacgacgacttgagcaaggacaaggcgtgccagttcaggatcgcccggcatgcatacgccggcggccaggggacgctccggtacagggtcgcccgcgacgtccccaccgcgtcctaccacgtgcgcgcctacgcgctggacgcgtccggggcgccggtgggctacggccagaccgcgcccgcctactacttccacgtcgcgggcgtctcgggcgtccacgcgtccctccgggtcgccgccgccgtgctctccgcgttctccatcgccgcgctcgccttctttgtcgtcgtcgagaagaggaggaaggacgagtaggccgtaagcggcacacgcgatatataccagggaggcgccaccgtgcgagctagcgcttggtgagccgtcatgttgtgtagtgcagttgtaacacaagtattaagctaagcacaagtcgtaccatgtatccagctccagcatgaatccaaacccagcgtcagtcacaagctggacctgcatggtgcctgtcaaccaaaattcttcttggatcatactaatactatcgtctacagcatatagaacttgtatcatactaatttacatggcaaaaaaaaaaaaaaaaa

SEQ ID NO: 96388 - protein, 197 aa, Zea mays
  misc_feature: Ceres CLONE 1638687
MTMARSGAALPLLLVVVGACCARLAAAVHLSALGRTLIVEASPKAGQVLHAGEDTITVTWHLNASASSVGYKALEVTLCYAPASQEDRGWRKANDDLSKDKACQFRIARHAYAGGQGTLRYRVARDVPTASYHVRAYALDASGAPVGYGQTAPAYYFHVAGVSGVHASLRVAAAVLSAFSIAALAFFVVVEKRRKDE

SEQ ID NO: 96389 - DNA, 1580 bp, Zea mays
  misc_feature: Ceres CLONE 1638895
  misc_feature: Encodes the peptide sequence at SEQ ID NO. 96390
agcaaacagcccaaagaacacacgcgtcttccccagaaagcagctgtcacacatatggagggcgccacaggctgcggcgtccatgtcgtttcccggcgcatggtgcgtccgttcacgccgccgccgccgccggcggtgaacgggaacggctgcaatcgacccaaggaggagaccgaggtgattcacctggcgccgtgggaccttcgcctgctcagcatcgactacatccagaagggcatccttctgcccaagcctccatccgagggcgacgacaacgacctccacctcgtcaacgccctgcggtcctcgttcgcgcgcgccctacggatcttctacccgttcgccggccggctcacctccgaggagcgagccgacgacgggaccgtgtccgtgttcctgcggtgcaccggcgaaggcgccgagttcgtgcacgcggtggcgccagaggtcgccgccgccgacatcgtctcctcgctgtacacgccgcccgtggtctggaagttctacccgctggcgctggttcttggcgctgacgccgccatcgagcggcttccggtgctcgccgctcaggtcaccgtgctcgccgacagcgtcttcatcggcatgacgctaaaccactccgtcggcgatggcaccgcattttggcacttcttcaacacctggtcggagatcaaccgcgccaccggcggcggcgccgacctgtccacgccgccgccggtgttcgggagatggttccccgaggcatgtccggtgccgatccccttgccattccgcaggctggaggacatcgtgcgccggttcgagcgcacggaggtgaaggagtgcttcttcaccttctccgcggcgagcgtcaggaagctcaaggcgcgggcgaacgacgagatggccggcagcgccacggccaccatctcgtcgctccagtcggtcctcgcgcacctgtggcgcgccgtgtgccgggcccggcgcctccccccagagcacggcacgttctactcggtggtggtcgggtgccgcgggcgcgtggacggcgtgccgccgggctacgtcggcaacgccatggtgttcggcagggcggaggccactgccggcgagatcgaggagaaggggctgggctggacggcgtggctgctgaaccgcgccgtggcgtcgttcgacgaagcggccgtgagggagtcgctggagcggtgggtcggggagccggacttcacgtacatggacaacctgtcctccgccggcacggcgctagtaaccgggagctcgccgaggttcgacgtgttcgggaacgacttcgggtgggggaagccgctggccgtccggagcggctccgggaacaaggccgacggcaaggccacggtgttcgaggggccggagcggggagggagcatatcgctagaggtgtgcatcgcgccggacgcgctccagaggctcgtcgccgaccacgagttcatggacgcggtgagcacgtatgtacgccggcatgatgagcttgatgcatgatcgacgtgcattaattaatcacttgtagttgacaacaagctgtcgtacatgttcatacgtgtagaggcaaaaaaaaaaaaaaa

SEQ ID NO: 96390 - protein, 480 aa, Zea mays
  misc_feature: Ceres CLONE 1638895
  misc_feature (7)..(465): Pfam Name: Transferase Pfam Description: Transferase family
  misc_feature: SWISSPROT Homolog: EC 2.3.1.144 Anthranilate N-benzoyltransferase
MEGATGCGVHVVSRRMVRPFTPPPPPAVNGNGCNRPKEETEVIHLAPWDLRLLSIDYIQKGILLPKPPSEGDDNDLHLVNALRSSFARALRIFYPFAGRLTSEERADDGTVSVFLRCTGEGAEFVHAVAPEVAAADIVSSLYTPPVVWKFYPLALVLGADAAIERLPVLAAQVTVLADSVFIGMTLNHSVGDGTAFWHFFNTWSEINRATGGGADLSTPPPVFGRWFPEACPVPIPLPFRRLEDIVRRFERTEVKECFFTFSAASVRKLKARANDEMAGSATATISSLQSVLAHLWRAVCRARRLPPEHGTFYSVVVGCRGRVDGVPPGYVGNAMVFGRAEATAGEIEEKGLGWTAWLLNRAVASFDEAAVRESLERWVGEPDFTYMDNLSSAGTALVTGSSPRFDVFGNDFGWGKPLAVRSGSGNKADGKATVFEGPERGGSISLEVCIAPDALQRLVADHEFMDAVSTYVRRHDELDA

SEQ ID NO: 96391 - DNA, 2629 bp, Zea mays
  misc_feature: Ceres CLONE 1639087
  misc_feature: Encodes the peptide sequence at SEQ ID NO. 96392
attcctccttttccacccctgccctcccccaacacaaagcgagattcttgcttgcttggcagagccatgtcaggaaagatttatctggtcggccgatcgagctcctctcctccgaagcactgaagctccagcggctgccctgcctgacagccactccgcacgacaaaattaaacgcgggcgatcaagatggcgcacgaccccagcctgggcttcgcagactacttctcggcggcggcggcggcgggcgccacggcgatggacgacgacgtcggggcgccggagctctatggcctgcatgccgacgacatggagttcctcggcatgcgtggcctggccgccatgccccccgccgcggcacaccaccagcaccaccaccatcacggccacagcaaggccggtgcgctcctcgacgacgacgacgcgggggtggggccagacgtcagcggctccgcggacgacgccaccatgcgcttcctgagcgagcagcagcagcagcagcaccaggcgccgctgtcgctgtcgctgtgccggccggacgtggcgacgacgttgcacgagcagcagcacctcgccggcggtggctcctcgtcccggtaccatcaggagcagcagccggcggcgtgggtgcagcagcagcacgactactcgccgtcgccgcagcagcacgcgtggcacctgcgcagctccaggttcctcgtcccggcgcagcaggtcctgcaggagttctgcagcctccccgtggacagcagcagcgctgccgcctccagcaagcgcgccaaggccgcaaataagccggcctcgcagcagcagcagcagcaagaagacggcggcggcgccgaggggtcgtcgtcgtcggcctcctgggcgccgtcgccgcagatccaggccatggacgcgctggagctgcagcggctcaaggacaagctctacatcatgctggaagaggtggaccggagataccggcggtactgcgagcagatgcgggcgctggcgggcgggttcgaggcggtggccggggagcgcgcggcggcggcgtacacggcgctggcgtcgcgcaccatctcgcggcacttccggagcctccgggacggcgtggtggcgcagctgcaggcggcgcgcagggcgctcggggagaaggacgtggcggtgcccgggatgacgcgcggggacacgcccaggctcagggtgctcgaccagtgcatccgccagcacaaggcgctcacccaggccgccggcatgatggagagccacccgtggcgcccgcagcgcggactccccgagcgcgccgtcaccatcctccgggcgtggctcttcgagcacttcctgcacccgtatccaagcgacgtcgacaagcatatcctggctcgccagacgggcctctcacggagccaggtgtccaactggttcatcaatgcgcgggtcaggctctggaagccaatggtggaggagatgtacgtggaggagatgaaggccgagggccaggacggcgggggccagcagcaggtaggcgtcgccgtcgccaacaaccctaaccctagcagcgccggccacgcctccgaggcggctgaggacgatgggcgcggggacagcggcggcggcgccgtcgtcgaccggaagccgacgcgggcgcagctcctgcacgacgccggctcgctcgcctcggtcgtcaacatcggcggcggatcgcgcgcgggattcggcatcatggaccacctcgacttcgacgcctacggcggccaccatgccggcgccgtgtccctcacgctgggcctgcagcagcacgactcccacgccgacggcggcgccggcggcgtcaacatcgcgttcggcgcgccgccgcccgcgcaccaccacgggtacctgttcgctccgacggcggcggcggcaggccatcagatgggcggcggcgtgcacccgggactacaccaccacgtccagttcagcggcgccggcgccggcatcgacggcgaggcggcgcacgggcaggagcactaccggggcctgcagggcggcggcgggttccacctcctgcgtgacctggccgggtgatcgatctgctccatccacggcccgtgcatccgcggtcggccgcgcgcgagctctagctgcgactccgagtgagctgagcgatggggacgtcgtgccggcgcctagctagctaccgggtgtccgcgccggattcatggcacgcactcgatcgcgcgtgcgctcatccggccacagcggcgctgtgtacgtacgcaccggatttgtttggcttgttgcttgcctggctcgtgccggtctccatcggtctcgatcgccgccggcggcggcttggccgggcccgggtctagctggctagctagctgccctagttatacataatatatgtatttgtagcgtgtacagatcgggtcgcgatcgagcagtttggacgcgcgcaggtgcagctagtactagtagtagctagcccgccggaactgcgtagttgatcaaacacgcattgcatgcaggttaattgcattgtttgtcaatttcttgaaggattcgacgacgtacggcacaatttataccaggcattattgacgattttcctggcagaatattcatcagtccatatgcccatgctaaaaaaaaaaaaaaaaa

SEQ ID NO: 96392 - protein, 620 aa, Zea mays
  misc_feature: Ceres CLONE 1639087
  misc_feature (162)..(305): Pfam Name: POX Pfam Description: Associated with HOX
MAHDPSLGFADYFSAAAAAGATAMDDDVGAPELYGLHADDMEFLGMRGLAAMPPAAAHHQHHHHHGHSKAGALLDDDDAGVGPDVSGSADDATMRFLSEQQQQQHQAPLSLSLCRPDVATTLHEQQHLAGGGSSSRYHQEQQPAAWVQQQHDYSPSPQQHAWHLRSSRFLVPAQQVLQEFCSLPVDSSSAAASSKRAKAANKPASQQQQQQEDGGGAEGSSSSASWAPSPQIQAMDALELQRLKDKLYIMLEEVDRRYRRYCEQMRALAGGFEAVAGERAAAAYTALASRTISRHFRSLRDGVVAQLQAARRALGEKDVAVPGMTRGDTPRLRVLDQCIRQHKALTQAAGMMESHPWRPQRGLPERAVTILRAWLFEHFLHPYPSDVDKHILARQTGLSRSQVSNWFINARVRLWKPMVEEMYVEEMKAEGQDGGGQQQVGVAVANNPNPSSAGHASEAAEDDGRGDSGGGAVVDRKPTRAQLLHDAGSLASVVNIGGGSRAGFGIMDHLDFDAYGGHHAGAVSLTLGLQQHDSHADGGAGGVNIAFGAPPPAHHHGYLFAPTAAAAGHQMGGGVHPGLHHHVQFSGAGAGIDGEAAHGQEHYRGLQGGGGFHLLRDLAG

SEQ ID NO: 96393 - DNA, 1953 bp, Zea mays
  misc_feature: Ceres CLONE 1639355
  misc_feature: Encodes the peptide sequence at SEQ ID NO. 96394
aagtctgacatccctttttttaatcagataatacacctcttcttccctcaccttcctccttctcccagctgcggcgccaccctcgggccgtccgccgtcggcggccacgaccctggtgtaatctgctccatacgtggcggcgcctgcaaaagccacgctgctgccagtgccagccatggatgcagtggcgaccagcgacgccgtactcctccttgccgccgtagctatctccctgctcatcactgccactttctggagcaggcatcgtcgtcagggcgaagcgccgagcccgccgtcgctaccgctgctgggccacctccacctgctcggcaacggcaagccgctgcaccactcgctggcggcgctggccatcgcgcgcggcaccgggggcgccccggcgccgctcctgtcgctgcgcctgggcgcgcggcgcgcgctgctggtgtcagagcacgccgcggccgaggagtgcttcacggcgcacgacgccgcgctgggcggccggccgcggctgctggtcggggacaggctcaactacgggtacaccacggtgggctggtcctcgcacggcgaccactggcgcgccctccgccggttcatggccgtcgagctgttcgccgcgtcccgcctcgccgcgcgcgccgccgaccggcgcgccgaggtcgccgcgctcgtcggcgccctggtccgcgacgccccccgcgccggcgccgcggtggcgctccggcccaggctcttcgagctggtgctgaacgtgatgctgcgcgcgctcaccggcgcgcccggccacggcggcggcgacgtgcgcggcctccaggagatcatcgaggagaccttcgcggtgaccggcgtcatgagcgtcggggacttctacccggcgctgcggtgggtggaccgtctgcgcggggtcgacgcggccctgctccgtctccaggcgagacgcgacgcgttcgtcgccggcctcgttcacgacggacgccgaagccacaatcgcaaagctggcggtggcggtggcccaacagacacggagaagaggagcaccattgacgagctcctgtcgctgcaggaaactgatcctggctactacaccgacactgtcatcaaaggcattgtctcgatactgctcagtgcgggcacagacacgacggcgctgacaatggagtgggcaatggcgcagctgctgatgcaccgggacgcaatgcagaaggcgagagccgagatagacgccaacgtcggcacatcccggctggtagacgagtcggacacgactcacctcccgtacctgcaatgcgtggtgaaagagaccctgcggctctgccccgtcggcccagtcatcccggcgcacgaggccatggaggactgcgccgtgggcgggttccgcgtccggcgcggcaccatggtcctggtgaacgcctggctcatccaccgggaccccaggctgtgggaggcccccgaggagttcaggccggagcggttcctggacgccactgccacggtcgccgcccccttgctgccgttcgggcttggacggaggcgctgccctggggaagggatggccttgcgtctcctcagcttgactctggcggctctcctgcagtgcttcgactgggaggtcggtgggtgtgttgacatggccgaaggcgttgggctgtccatgcccatggccaagccgttggcggcagtctgtcggccccgggagttcgtccagaccgtgttgtctgcttcaacatgagtagccggatgcggttcttttccctgatacatgaatccagaaggggattgaagaggtttaaatccccttctagttatttttgactaggaggaggtttaaatccccttctaattatttttgactaggaggagatttaatcccctctatctctttctggattgttgtaaccaaacatgcccccgaagaataaataaggattgggtgaaaaaaaaaaaaaaaaa

SEQ ID NO: 96394 - protein, 518 aa, Zea mays
  misc_feature: Ceres CLONE 1639355
  misc_feature (37)..(505): Pfam Name: p450 Pfam Description: Cytochrome P450
  misc_feature: SWISSPROT Homolog: EC 1.14.13.89 Isoflavone 2'-hydroxylase
MDAVATSDAVLLLAAVAISLLITATFWSRHRRQGEAPSPPSLPLLGHLHLLGNGKPLHHSLAALAIARGTGGAPAPLLSLRLGARRALLVSEHAAAEECFTAHDAALGGRPRLLVGDRLNYGYTTVGWSSHGDHWRALRRFMAVELFAASRLAARAADRRAEVAALVGALVRDAPRAGAAVALRPRLFELVLNVMLRALTGAPGHGGGDVRGLQEIIEETFAVTGVMSVGDFYPALRWVDRLRGVDAALLRLQARRDAFVAGLVHDGRRSHNRKAGGGGGPTDTEKRSTIDELLSLQETDPGYYTDTVIKGIVSILLSAGTDTTALTMEWAMAQLLMHRDAMQKARAEIDANVGTSRLVDESDTTHLPYLQCVVKETLRLCPVGPVIPAHEAMEDCAVGGFRVRRGTMVLVNAWLIHRDPRLWEAPEEFRPERFLDATATVAAPLLPFGLGRRRCPGEGMALRLLSLTLAALLQCFDWEVGGCVDMAEGVGLSMPMAKPLAAVCRPREFVQTVLSAST

SEQ ID NO: 96395 - DNA, 1131 bp, Zea mays
  misc_feature: Ceres CLONE 1639822
  misc_feature: Encodes the peptide sequence at SEQ ID NO. 96396
taacccaataacgaaagtttcgtaaggggactggagcaggctaccatgagacaaaagatcttctttctaaagagattcgattcggaactcttatatgtccaaggttaatatggaaattctttcagaggttttcccttactttgtccgtgtcaacaaacaattcgaaatacctcgactttttcagaacaggtccgagtcaaatagcaatgattcgaagcacttctttttccattacactatttcggaaacctaaggactcgatcgtatggatatggaaaatacaggatttccggtcctagcgggaaaaggagggaaacggatactcaatttaaagtgagtaaacagaattccatactcgatctcatagatccctatagaattctgtggaaagccgtattcgatgaaagtcgtatgtacggcttggagggagatctttcctatctttcgagatccaccctacaatatggggccaaaaagccaaaaataagtgattcgtttttagcccttataaaaagaaaacggattcttgaacctctttcacgctcatgtcacgtcgaggtactgcagaaaaaagaaccgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggagtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaatagaaggagaatcggacgatatctttttcgaaacaaaaaaaaaaaaaaaaa

SEQ ID NO: 96396 - protein, 156 aa, Zea mays; identical to SEQ ID NO: 80665
  misc_feature: Ceres CLONE 1639822
  misc_feature (1)..(150): Pfam Name: Ribosomal_S7 Pfam Description: Ribosomal protein S7p/S5e

SEQ ID NO: 96397 - DNA, 1000 bp, Zea mays
  misc_feature: Ceres CLONE 1640003
  misc_feature: Encodes the peptide sequence at SEQ ID NO. 96398
aactggtgaaattgaatcctgaacccatctctactgtttgtcctcctgtagctctcctctgatcccccactccctcctatttcagtatcttccaagtccgtcccagtagttagttgcattggcaaaactttaacaagtcatagtaaattagtaacgttttttatttattgtgaaattttttacaagtctactttgaatttttatgctgtcaggtagtaaaagtggagcattgtgaaagagtgcatatcattgcagctgcaaaacggatttgtattgccaactgccgggaatgcatcttctacataggagtaaatcaccaacctcttgtgttgggggacaaccataaattacaaattcctagttggtttggggatgaaaggcaagggactacaaaccgcaatcctttcccactgcctgaaatttatgggacatcccaaagcaaaaagcgttctgctctggaagatatccaaaagatgattcgggagctgcagcttgatgagaaccggaaaagggaattggcaactgcccttcacgttcagttcaaggattggttatacgcttcaggcaatatccgccagctctactgtctacagggcgattaacgatgggatttgcaagactgactacccttttgccgactcctactccaaaacattcgacaattgtcgaaagctgaccttcctttccctgggagagaggattcccacccgcgcagaaggatgtgaagatgtactgttacctacttttttacagattcatttgggtatattccctttgctgcgagttggaggtactaattaagatgtaatctccaagcctactcattttttttggcccttgataacgtccacgagtatgtaatagggactggtgaatcatacgttgtaaacatttcttcatcccgttttgctaaatggctcgtcatgtcaaccctctattggatcaactgtattgtgctcatccttatagacatgcttgtttgcaaaaaaaaaaaaaaaaa

SEQ ID NO: 96398 - protein, 101 aa, Zea mays
  misc_feature: Ceres CLONE 1640003
MRTGKGNWQLPFTFSSRIGYTLQAISASSTVYRAINDGICKTDYPFADSYSKTFDNCRKLTFLSLGERIPTRAEGCEDVLLPTFLQIHLGIFPLLRVGGTN

SEQ ID NO: 96399 - DNA, 1137 bp, Zea mays
  misc_feature: Ceres CLONE 1640177
  misc_feature: Encodes the peptide sequence at SEQ ID NO. 96400
aactcctctaccagccggcgcacgccgacgggcacagtagcgaccgcgagcgagccagagcatgggtgacactggcgcgaacatggcccactggggcgggctctacggccggggcggcgcgccggcgacgacggaggcggtgacgacggcaggaggcggcgggtcggtgtcgagccctacgtcgggcgggtcgggcggtagcccgagccgcgcgcagctgcagcccggggtcggggtggagggcgggcgcgtgggcaagcccgcgcggcggcggtcgcgcgcgtcccgccgcgcgcccgtcacgctgctcaacaccgacacctccaacttccgcgccatggtgcagcagttcaccggcgtcccgcccgggccctacggccccggccccggcggcggcggggggcccgtcatcagcttcggcgccgagtacggcggcgcgcagctggtgcgcccgtcgccgacgtccgccgtcatgtcgttcgacccccagcaccaccaccaccggccgacggcggcgtcgtcgctgcagagccagctgttcaggccgcagcagcagcagcagtacggtgccgacgtcggcggctacggcgtgcacggcatggccatggcggcgccgtcctccttcctgcacggcgggttcgaggcctcgtcggaggaccggctgctgctgcagagcatgatgcaggcctcgacgatgcccaccggccacccgccccccactaacaacggcaatggataccacttcggctagctgatcgatccaccggtttgatccccaccgcacaaccgaggtaattaatataataagcggggagctagatcagggatccatggaacgaagaagccgtcgtcgatgaccacgagctgatgatgacgcgtgttctagcttgttgctgctgcttaagcagctaagcattttttttgttatgttttttttgctggcctcgcagaaggctagctaattacgagtaagtaactaagtatagttagtagtggtagtgttatcttgctgctttaactagaaaaggagttaagctaggtcgatgtaaatagttccctttccttttttttctttttctttttgaaaaaaaatatcaatcaagaagtttaattttgggccaaaaaaaaaaaaaaaaa

SEQ ID NO: 96400 - protein, 229 aa, Zea mays
  misc_feature: Ceres CLONE 1640177
  misc_feature (76)..(106): Pfam Name: VQ Pfam Description: VQ motif
MGDTGANMAHWGGLYGRGGAPATTEAVTTAGGGGSVSSPTSGGSGGSPSRAQLQPGVGVEGGRVGKPARRRSRASRRAPVTLLNTDTSNFRAMVQQFTGVPPGPYGPGPGGGGGPVISFGAEYGGAQLVRPSPTSAVMSFDPQHHHHRPTAASSLQSQLFRPQQQQQYGADVGGYGVHGMAMAAPSSFLHGGFEASSEDRLLLQSMMQASTMPTGHPPPTNNGNGYHFG

SEQ ID NO: 96401 - DNA, 929 bp, Zea mays
  misc_feature: Ceres CLONE 1640422
  misc_feature: Encodes the peptide sequence at SEQ ID NO. 96402
aagcgcagcgagctctctcctcgtagcggagtcccagcccctcacgccctcccgatcgcgctcgtcggcgcccttgtcgactcgagcccgcttctgggccgatcgacagcgagagcgagagcagcggcgcgccgaggagagctctttcggtgctgctgtataacgacgacgacagcaggcggcagataacacataaaggcgcgcgatgtgcgacgcggcggccgtggcggctccgcggtacaggggcgtgcggaagcggccgtggggccggttcgcggcggagatccgggacccggcgaagcgcgcgcgcgtctggctcggcaccttcgactccgccgaggccgcggcgcgcgcctacgacgtggccgcgcgggccctgcgcggcccgctcgccaggaccaacttccccgcgctcacctcccgccctcctgccaacctgcccgcgcccgcgcccacgtgcagctcaagctccaccgtcgagtcctccagcgggccccgcgccggggtgcccagggcgggcaggcgcgctgctgggaagccgcgtgccccgccgacgccgactgccgactgccgtagcgactgcgcctcgtcggcctccgtcgtggacgacggcgacgacgcctccacggtccggtcgcgcccggcgctcgacctcaatctccccgcgccgctcgacgtcgacgatggtcatgacctcgagctttgtacggacctgcggctctgaataggcgaccggatccacggacggatcgggacgaagggagagaaggcggtttttgctttggtcttcttttcttgatcagattctgccttgctttgacttgtcgtgctcgagggagcttgtaccagtgctgcactgtactactcgatacgaatggcaatagaattggatgacgattcctgcaacgctatgcaaaaaaaaaaaaaaa

SEQ ID NO: 96402 - protein, 172 aa, Zea mays
  misc_feature: Ceres CLONE 1640422
  misc_feature (10)..(61): Pfam Name: AP2 Pfam Description: AP2 domain
MCDAAAVAAPRYRGVRKRPWGRFAAEIRDPAKRARVWLGTFDSAEAAARAYDVAARALRGPLARTNFPALTSRPPANLPAPAPTCSSSSTVESSSGPRAGVPRAGRRAAGKPRAPPTPTADCRSDCASSASVVDDGDDASTVRSRPALDLNLPAPLDVDDGHDLELCTDLRL

SEQ ID NO: 96403 - DNA, 990 bp, Zea mays
  misc_feature: Ceres CLONE 1640475
  misc_feature: Encodes the peptide sequence at SEQ ID NO. 96404
agagcaacacacccctcatcacttcatcagcacactcctgcttcctgcccccggccccccatttaaacgcttagtttgaagcggtgctagctagctgctttgctcagctcgcaagcatgcatataaactcttgtctcttctcacgcagtgacgcagagctagctagctagtagctagctgcgcatcggcagtacgtacgtagatcccgggcgggcaatcgaaccgcaaacgcctctgggtttcgggaagggtgctttttgctctttgcagccacagctggccggcgcccctggtgttttatataacttggaaggttcagtcgctgacagagaggaagaagaaggaggatggggaggaagctgggcctcgacagggtcctcgactgcttctcgctctccctgtgctccagcgcctgcgcctgcgtacactccgtggaggaggaggaggaggaagacgaggacgagcggaaggccctggtgagcagccagctggaggagctggtgaagctgagcagggatctcgtcggcggagccgccaagacactcgctttccatctggaaccaaagaccgtggagctgaaggtgtccatgcactgctacgggtgcgccaagaaggtccagaagcacatctccaagatggacggcgtcacgtcgttcgaggtggatttggagaagaagaaggtggtggtgatcggggacgtgacgccgtacgaggtgctggcgagcatctccaaggtgaagttcgcggagctgtgggtgggcccccaaccccaacaaccccaagcagcaagccgctgcggaaaggcgcatgcaggtggtgtagtgtagtgtatgtgtagaagatctatctcccaatggatgctcatgtgttctctagctcgtattcatcctgcatgggcgggcggtcgggcgggcaaaaccactcagaaatgtaagccaccaggaagcaatgcaagcaaccatgcgttcgtgcgtaaaaaaaaaaaaaaaa

SEQ ID NO: 96404 - protein, 159 aa, Zea mays
  misc_feature: Ceres CLONE 1640475
  misc_feature (76)..(143): Pfam Name: HMA Pfam Description: Heavy-metal-associated domain
MGRKLGLDRVLDCFSLSLCSSACACVHSVEEEEEEDEDERKALVSSQLEELVKLSRDLVGGAAKTLAFHLEPKTVELKVSMHCYGCAKKVQKHISKMDGVTSFEVDLEKKKVVVIGDVTPYEVLASISKVKFAELWVGPQPQQPQAASRCGKAHAGGVV

SEQ ID NO: 96405 - DNA, 2045 bp, Zea mays
  misc_feature: Ceres CLONE 1659521
  misc_feature: Encodes the peptide sequence at SEQ ID NO. 96406
aaccattcactcaccctgcccacccgaacaataaccaacagcttcaccctcctcctccagtgcaggccgtcggcggctggcggcgtcatttctcctccttcctctggcctgccctgccctgcccgcgcgataaccatctctcgcaactcctcttcgtactcctcgtctccaacgccggcaacaactacagagcttcagcttcccaagcgcgagacatgcgtgcggaaacacagacggcggagtagcgtagcgccacgatgggattgccaagctggtaggtagccaagaagacatgagatgggggcgtccttgggctccgccgccagcaagaaccggcagcaggagcacggcggcgaggctccgcgaccagatccctgcaagaagacgcggctctcgacccctctctgcactatccacggccactcgaggctgatcccggggctcccggatgaggtctctctgcagatcctcgcgaggatgccgcggatggggtacctcaaggccaagatggtctcgcggagctggaaggcggcggtgaccggcgcggagctgtaccggctgaggaaggagctcggcgtggccgaagagtggctgtacatactgacgaaggcggcggcaggtgggcagaagctggtctggcacgctctcgatccggttagcaaccaatggcagaggctgccgctcatgcctgggatcgagtgcaggagtggcggcgtgtacgggctgggcttgcgggacctggtgagcgccggcgtaggtatcttcgacgtcatcagaggctggctcgggcagaaggagctgtcaggcggcgtaccaccgttctgtggctgcgccgtcggcgccgctggtggctgcctctatgtcctgggcggcttctccggagcttccgcgtcgaagcgcgtgtggaggtacgacccctccgccaactcatggcgggaggtgagcccgatgcgcgccgggcgcgccttctgcaaggcgagcctgctgaacgacaagctgtacgtcgtgggcggcgtcagcaagggcgagaacgggctaatagctccgctccggtccgccgaggtgttcgacccggcgactggggcctgggccgagctgccggacatgctgttctccaagtcgcaggccatgccgacggccatagctgacctgctcaagcccgtcgccgccggagtgacctcgtacggggggaagctgcacgttccccagagcttctattcctggccattcgccgtcgacgtcggcggagaggtgttcgatccggagacgaactcgtgggagcagatgcctgcgggcatgggcgagggctggcctgcgaggcaggctgggacgaggctgagcgccgttgtggaaggagatctgtatgccctggagccggcgacctcctcttccggcggttgtgagatcaagatgtacgacgcgcaggaggatgcttggaaggtcgctgtgagccaggttcgtgctggggcatttgacgagtcggacagcccttgcttgcttgctgcgtttcttggaaagctccatttggtcgtcaaggatatgggcagcaggatcagtgtcatgcagatggactctctgatgaagccagtggattcgccagccctttcggctgccacgacatgccgaaccccggatgtctcctcggagcatacacatgtctggaaagccattgcatcgaagaacattgcagctgctgaacttgtcagctgtcaggttctcagcatctgagttcgtaaaatcgagcttctctggaacttctttgtgtaagtctgtgcagtagatgtgtttctgccacacatctgaacatcagaggctatttctttctttcagcaatgcacaattgtttgtgcaatctgcgtaattgttatctgtgtatataacatcacatagaactgaataaggttgacgcagctttgtccaatcccaaaggcaacggcgccgactcaatcaatcaccggaccaatctgaaccctgttcattgttcagactgctgtgcattcctgttttcacacaccttctagtttggttttctccaaaaaaaaaaa

SEQ ID NO: 96406 - protein, 476 aa, Zea mays
  misc_feature: Ceres CLONE 1659521
  misc_feature (174)..(219): Pfam Name: Kelch_1 Pfam Description: Kelch motif
  misc_feature (221)..(271): Pfam Name: Kelch_1 Pfam Description: Kelch motif
  misc_feature (44)..(91): Pfam Name: F-box Pfam Description: F-box domain
MGASLGSAASKNRQQEHGGEAPRPDPCKKTRLSTPLCTIHGHSRLIPGLPDEVSLQILARMPRMGYLKAKMVSRSWKAAVTGAELYRLRKELGVAEEWLYILTKAAAGGQKLVWHALDPVSNQWQRLPLMPGIECRSGGVYGLGLRDLVSAGVGIFDVIRGWLGQKELSGGVPPFCGCAVGAAGGCLYVLGGFSGASASKRVWRYDPSANSWREVSPMRAGRAFCKASLLNDKLYVVGGVSKGENGLIAPLRSAEVFDPATGAWAELPDMLFSKSQAMPTAIADLLKPVAAGVTSYGGKLHVPQSFYSWPFAVDVGGEVFDPETNSWEQMPAGMGEGWPARQAGTRLSAVVEGDLYALEPATSSSGGCEIKMYDAQEDAWKVAVSQVRAGAFDESDSPCLLAAFLGKLHLVVKDMGSRISVMQMDSLMKPVDSPALSAATTCRTPDVSSEHTHVWKAIASKNIAAAELVSCQVLSI

SEQ ID NO: 96407 - DNA, 1942 bp, Zea mays
  misc_feature: Ceres CLONE 1659757
  misc_feature: Encodes the peptide sequence at SEQ ID NO. 96408
aggcgtaggaggctgctgacactactgcagagcagggcagccatgaggcttcctctccctctgctggccctggtgtgctgcgccctgatggcgcgccagcattgcgctgcggcgggcaaggcccggcacttgaggtgggagatcagcaacatgttctggtctcccgactgcgaggaaaaggtggtgatcggcatcaacgggcagttcccgggcccgacgatccgcgcccgggctggcgacaccgtccacgtccagctcaggaacgcgctccacaccgagggcgtcgtcatccactggcacggcatccgacagatcgggacgccgtgggcggacggcacggcggcgatctcccagtgcgccatcaaccccgaggaaaccttcacctaccgcttcgtcgtcgacaagccggggacgtacttctaccacgggcactacgggatgcagagggcggcggggctgtacgggtcgctggtcgtggacgtggcggagggggaggaggagccgttccagtacgacggcgagctcaacctgctgctcagcgactggtaccacgagagcatccacacccagatggtcgccctctcgtccaggcccttcaggtggatcggcgagccacagtctctgctgatcaacgggagaggccagttcaactgctcgctggccgcagcgcacatgcagggggccaccaaccagtgcgccgccaccgccgccaacacgcagtgcgcgccggtggtactccccgtgcaaccgaacaagacctacaggctcagggtggccagcaccacctcgctcgcgtctctcaacctcgcgatcgggaatcacaagctgacggtggtggaggccgacggcaactacgtggacccgttcgttgtggacgacatcgacctctactccggggacagctactccgtcctgctcacgacggaccaggacacgtcctcgaactactggctcagcgtgggcgtgcgcggcaggctgcccaagacggcgccggcgctggcagtgctcaactaccgccccaaccgcgcgtcggacctgccagccctcgcgccgccggtcaccccggcgtgggacgactacggccacagcaaggcgttcacgtacaggatccgcgcgcgcgccgggacgcccccgccgccgccgacggcggcccgccgcatcgagctgctcaacacgcagaaccggatggacgggcgcatcaggtggtccatcaacaacgtgtccatggttctgcccgccacgccgtacctgggctccctgaagatggggctcaagtcgacgctggcggcggcgcgccccgcggagacgttcagccgggaatacgacgtgacgctgccgccgccgaaccccaacacgacggtgggggacaacgtgtacgtcctggcgcacaacaccaccgtcgacgtcctgctccagaacgccaacgcgctgtcgcgcaacgtcagcgaggtgcacccgtggcacctccacggccatgacttctgggtgctgggctacggcgacggcgcgtaccgcggggacgccgccgacgaagcgcggctcaacctccgggacccgccgctgcggaacacggcggtcatctttccgtacgggtggacgatgctccggttcgtggcggacaacccgggcgtgtgggccttccactgccatatcgagccacacctccacatgggcatgggcgtcatcttcgctgaggctgtggacctcgtcgccaaggtgcccaacgaggctgtgtcctgtggcgccacggccaccgcgctcatggccggcggtcacctgtgattgccatcaaatattggtggccaggctagggaaccgccttgcctcgcgcgcatgcatattaatgcccttctgtcgtacgagatctctggtcattaattagtgttatttattaatatttcttctatatcttttttccgtttatcaaaaaaaaaaaaaaaaa

SEQ ID NO: 96408 - protein, 579 aa, Zea mays
  misc_feature: Ceres CLONE 1659757
  misc_feature (159)..(327): Pfam Name: Cu-oxidase Pfam Description: Multicopper oxidase
  misc_feature (33)..(150): Pfam Name: Cu-oxidase_3 Pfam Description: Multicopper oxidase
  misc_feature (428)..(555): Pfam Name: Cu-oxidase_2 Pfam Description: Multicopper oxidase
  misc_feature: SWISSPROT Homolog: EC 1.10.3.3 L-ascorbate oxidase
MRLPLPLLALVCCALMARQHCAAAGKARHLRWEISNMFWSPDCEEKVVIGINGQFPGPTIRARAGDTVHVQLRNALHTEGVVIHWHGIRQIGTPWADGTAAISQCAINPEETFTYRFVVDKPGTYFYHGHYGMQRAAGLYGSLVVDVAEGEEEPFQYDGELNLLLSDWYHESIHTQMVALSSRPFRWIGEPQSLLINGRGQFNCSLAAAHMQGATNQCAATAANTQCAPVVLPVQPNKTYRLRVASTTSLASLNLAIGNHKLTVVEADGNYVDPFVVDDIDLYSGDSYSVLLTTDQDTSSNYWLSVGVRGRLPKTAPALAVLNYRPNRASDLPALAPPVTPAWDDYGHSKAFTYRIRARAGTPPPPPTAARRIELLNTQNRMDGRIRWSINNVSMVLPATPYLGSLKMGLKSTLAAARPAETFSREYDVTLPPPNPNTTVGDNVYVLAHNTTVDVLLQNANALSRNVSEVHPWHLHGHDFWVLGYGDGAYRGDAADEARLNLRDPPLRNTAVIFPYGWTMLRFVADNPGVWAFHCHIEPHLHMGMGVIFAEAVDLVAKVPNEAVSCGATATALMAGGHL

SEQ ID NO: 96409 - DNA, 1843 bp, Zea mays
  misc_feature: Ceres CLONE 1660425
  misc_feature: Encodes the peptide sequence at SEQ ID NO. 96410
agcgcacccagatagacagagccacctcacccccacttcgccctccactcccggtctcccgcaccgtgtccgtgccgacacccaaggcccgccaggaaagcgaaagagagcgtcagtcacgcacgcaccgatggcggacgtgtcgccgctactgccgccggggaagccaccggccaccacggcgcggttcgcgcggtgcgcgtcgagcgcgaacgacgagctccgcagcttccgcgcctgcctggcctggctctgcgtggaccactactcctccccgcgcgtggcggccgtgggctcctgggcggtcttcctcctcctcgccgtcgccgcgcccgcggccgtccgcctcctgggcaccgctccgccgcggcccttcgacgggcaggtccaggtctcgctcaccctggccgcgtcgctcgcctacgtctgcctccgcgcgctcctccaccgcgcggggggcctccgccgcctgctccacctcgacagcctccgccgcgactccgaggacgtgcaggcgggctacgccgcgcagctcgcgcgctccttccgcgtcctcgcctgcttcgtgctcccctgcgccctcgccgaggccgcgtacaaggcctactggtaccgcgccgccgccgccgcgtacggctccccgtggtggtgggccgccgcggcctgcgccgtcgaggtcgcctcctgggtgtaccgcgtcgcgctcttcttcatggtctgcgtcctcttccgggtcatctgctacctgcagatcctgcgaatggtcgggttcgcgcgcgagttcggcaggttcgccgacgtcgccaccgtgctgcagcaccaccgccggatcagggagcagctcaggaagatcagtcaccggtaccgcaagttcatagtctgcagcctcgtgctcgtctccgccagccagttcgccgcgctactcgccaccaccaggccgcacgccatcgtcaatctcgccaccgcaggcgagctcgcgttgtgctcggtcagccttgtggcgggtctgctgatgtgcctgtacagcgcggcgaagatcacgcacaagacgcaggcgatgacgagcgtggcggcggcgtggcacgcggacgccacggtgcacgccttcgacaacgaccaggagaacccggacccggacctgccgcccaccgcgggctacctggcgcccgccaacgcctaccgcgtggccgccggcgacgagtccggcagcggcggcgacgacgacgacgacagccggagcgagtgctcctcgctcgacgacccaaagtacgtgccgttccaggccaacaacatcagcttccagaagaggcaggcgctggtgacgtacctggagaacaaccgggcggggatcacggtgtacggcttcgtggtggaccgggcgtggctgcacgcgctcttcatgatcgagttctcgctcgtcatgtggctgctcgggaagaccgtcggcatctcctgagctcacgcacaccctttttttgccggctctggctcctgtcaggtgcagagttctcagcggaggattgtacaaagtgagtgcagatacaagatactctgatcatctgatggagatcagaacagctgctttgatttgtaggttcatttgacagctcgtatgttagatatcgcaacttctagttcgtgtgttttgatttgtgcttgttttttttttcactgcgttgcttcctccggtatgtcggggtttttttttttttttttttttgtaactgacgcttcatagacacaagtgatgcacgtgctgtggtgtgctgtgaaatggaatttgcaaggaaaaaaaaaaaaaaaaaaaaaaaaaaaaaaaaaaaaagaaaaaaaaaaaaaaaaa

SEQ ID NO: 96410 - protein, 441 aa, Zea mays
  misc_feature: Ceres CLONE 1660425
MADVSPLLPPGKPPATTARFARCASSANDELRSFRACLAWLCVDHYSSPRVAAVGSWAVFLLLAVAAPAAVRLLGTAPPRPFDGQVQVSLTLAASLAYVCLRALLHRAGGLRRLLHLDSLRRDSEDVQAGYAAQLARSFRVLACFVLPCALAEAAYKAYWYRAAAAAYGSPWWWAAAACAVEVASWVYRVALFFMVCVLFRVICYLQILRMVGFAREFGRFADVATVLQHHRRIREQLRKISHRYRKFIVCSLVLVSASQFAALLATTRPHAIVNLATAGELALCSVSLVAGLLMCLYSAAKITHKTQAMTSVAAAWHADATVHAFDNDQENPDPDLPPTAGYLAPANAYRVAAGDESGSGGDDDDDSRSECSSLDDPKYVPFQANNISFQKRQALVTYLENNRAGITVYGFVVDRAWLHALFMIEFSLVMWLLGKTVGIS

SEQ ID NO: 96411 - DNA, 2407 bp, Zea mays
  misc_feature: Ceres CLONE 1661325
  misc_feature: Encodes the peptide sequence at SEQ ID NO. 96412
aattttccttcccgtttggttttgatctcaccgcccaaataatacggacggtgggacgcggacgccacccagacccatggacgtcctgagattcgtgcccggagtcaggccgccgctgccaaccttcgccacgccggtatcccccgcgactgctccctcgccgcacgccgccgccgccgccgccgccccaggccccgggttccactccgggatgctgggcctgtggccgcgccgcgcgggagagaatgccctgggagccgcggctgaggcggcgggcgtcgaggaggcgagggaacgccgtcgcaggcgggcggtggaggcggaggacggcaggggaggcaactgggtgctgcagatactgcgcgtgcagtcatcgccgccgccgtcgccgtcgcgcgacgatggccgctgcggcgtcgacgacggcggctcggtgcctggttccggcgagggagacgggagtagccagcggtgcgtggagaggggcggcgtcggaccggacagcgaggaaggctgctcggtggctgacggtgaggagctcgatcgggccgccttctcgaggttgctgcggaaggtgtcgctcgcggaggccaagttgttctccgagatgtccggcctctgcaacctcgcctacatggttccccggatcaagccaaggtatctccacaagtacaacatgacgtttgtgacatcatcagttgaagagagggccaaacttccaaacccttgtaaccaggaggaccaaaatctcaatggcaggaagaatgcaaacataagcacgtcatccagacattctgatgaacaagagtcaacatatggcgctacctctgaacatgagagaatgcaggagaaccaaagtggccaagggataaatccattggcagcttatcgaattgctgcatctgctgcttcctacatgcaatctcgagccatggaagttcttccctttggttctcagaatgaggctaggcgagatcgaactatccaggccattgtaaatgcacaaactgaaggtctgactatggacgaggcttcgtttgtggccacaacgaattcaatgacctcaatggttgctgcaaaggaggaaacaaagcaggcagttgcagatgacctgaactcttcaagatcttgcccttgtgaatggttcatttgtgatggaaatcggaacagcacaagatattttgtgattcagggctcagagacaattgcttcatggcaggcaaaccttctatttgaaccaattaaatttgagggtcttgacgtgctcgttcacaggggaatatatgaggctgccaaaggaatataccagcaaatgttgccatatgtcaaatctcacttcatagttcatggcgaatctgcaagattacgattcactgggcattctcttggcggaagcctggctttgcttgtgaacctgatgttcctaataagaggagtagctcccgctgcttctctgttacctgtcataacatttggttcaccatctgtcatgtgtggtggtgattacttgcttcaaaagcttggtttgccaaaaagtcacgtgcagtctgtgaccttgcaccgggacattgttcctcgagcgttttcttgtcactacccggatcatattgctagcattctgaaacttgtcaatggaaacttccgcagtcacccttgcctgacgaaccagaagctgttgtatgcgcctatgggtgaggtgttcatattacaaccagatgagaagttgtctccccatcaccaccttcttccagcaggcagtggcctgtacctcattggcggacagacagtggattcaggcacttcgtccacagcactgcggtctgcattgtctgccttcttcaactccccgcatcccctcgagatcctcagggacgctggtgcctatggtcccaagggcactgtctacagagaccacgacgtgcactcgtatctaaggtcgatacgagctgtggtgcggaaggagatgagggccgagaaggagaggcgccggctcctgcggtggcccatcgaggtgtatggtgcgctcgccaccatagaccggaggcaagtgctgaggcagctccggaggcatgcgcacttgctggtcgttttcttgttgccggcaaagctgctcttcctgggcgtcctgtcactcatccgacccacctgaccaatgtgtttgtacattagattcatctccctttttttaactcattcgattcatttgttcatgcataattattgatttattgtggtagccaaatagtcagggctgatttggcagagctccctggggctgggaaatacatcaaaaagagcatgactgattgtaaatttgatgactgagctaaaagctgagatgggcacgaaactacatggctagccagctgtgtaacatgggtttgcttaataaaaaaaaaaaaaaaaa

SEQ ID NO: 96412 - protein, 690 aa, Zea mays
  misc_feature: Ceres CLONE 1661325
  misc_feature (368)..(507): Pfam Name: Lipase_3 Pfam Description: Lipase (class 3)
  misc_feature: SWISSPROT Homolog: EC 3.1.1.3 Triacylglycerol lipase
MDVLRFVPGVRPPLPTFATPVSPATAPSPHAAAAAAAPGPGFHSGMLGLWPRRAGENALGAAAEAAGVEEARERRRRRAVEAEDGRGGNWVLQILRVQSSPPPSPSRDDGRCGVDDGGSVPGSGEGDGSSQRCVERGGVGPDSEEGCSVADGEELDRAAFSRLLRKVSLAEAKLFSEMSGLCNLAYMVPRIKPRYLHKYNMTFVTSSVEERAKLPNPCNQEDQNLNGRKNANISTSSRHSDEQESTYGATSEHERMQENQSGQGINPLAAYRIAASAASYMQSRAMEVLPFGSQNEARRDRTIQAIVNAQTEGLTMDEASFVATTNSMTSMVAAKEETKQAVADDLNSSRSCPCEWFICDGNRNSTRYFVIQGSETIASWQANLLFEPIKFEGLDVLVHRGIYEAAKGIYQQMLPYVKSHFIVHGESARLRFTGHSLGGSLALLVNLMFLIRGVAPAASLLPVITFGSPSVMCGGDYLLQKLGLPKSHVQSVTLHRDIVPRAFSCHYPDHIASILKLVNGNFRSHPCLTNQKLLYAPMGEVFILQPDEKLSPHHHLLPAGSGLYLIGGQTVDSGTSSTALRSALSAFFNSPHPLEILRDAGAYGPKGTVYRDHDVHSYLRSIRAVVRKEMRAEKERRRLLRWPIEVYGALATIDRRQVLRQLRRHAHLLVVFLLPAKLLFLGVLSLIRPT

SEQ ID NO: 96413 - DNA, 2091 bp, Zea mays
  misc_feature: Ceres CLONE 1667136
  misc_feature: Encodes the peptide sequence at SEQ ID NO. 96414
agctgtctctcctttttttcttacggctccacatgccatgctgatccgcgcgggcgtggttttcctcttcggggctggggctgcacctgcactgcacgagggccgcgcgtaaacctcgccggggcgctgtcatctgctgctgcctaataccaagccctctcttttgccgccgctccaaagtttctcgcttccatctcgtgagcttctctttctgacgctggtgcaagctgagcttggtttctgcttcttgtactccaatccgctcgtgcaattcgcctccgtttggcagctctgccgttcccctaccgaacgcgaggaaaaaaaaggtttgtgttccttcaaaattcccatctgcagcggcgctccagttcttcttcgattaattgctctgctcctactcctacctacctacgtcgatgaattccgcccgttgaggctcccatctcggcacggttgccttgcccccgcccttcgcgttccttccttccgctcaccggtttcttccttgcgttcttctggtgcgcagagaacagcaggcgcagcatgaggcgcgtcgtgaggtggctcaggcagctactggcgggcaggaaggacgagcgcggaggaggactcgaggtgagccatgtcggtagcggctggagcgacgggccggagaaggagaagaagaggtggagcttcgcgaagcagaggaagagcggaggcggaggcgcgcggtcgtcgggtccggacgccgtcgctcctgctgccgcggtggaacggtcgcagctggtggggaggccaggggaggacgcgagggctcgagaacaccgtgccgcgatcgccatccagaaaaccttcagaggctacctggctaggagagcgctccgagctctccggtcgctcgtcaagatccaggcgctggtacggggctacctggtgaggaagcaggcgaccatgacgctgcacagactgcagacgctcatgcggctgcaagccgactccatcgccgtcaagaatgcatcgtaccggagatccatggaacaagaagagagggtctatgctcgggacgtccaggtgaagccgctcgcgacggcgccggcgcaccgccggatgctgtctgacagctcggactccatctacgagcgcagcccgcggatcgtggagatggacacttgccacctccgctcccggtcctcacggatcaccagcaggtacaggtacaagtacaacccggatggcttaccggagtaccaccaccgccacgcggcgccgacgccgtcgtgctcgccccttcccgcgcgcaacggcaagcatcagcccgcgcggctctcgttccggcagagcgcccgcgagcgcgacccccggggctccaagactgcgcagagcacgccccggctcgcctccccccacgactcctcctcgcccgccaagagcgtcgagcacagcctggccagcacgccgcggcggcgccccacggcgcagcgggaccgggaccgggacgcgctcgtcagcccgcggtacatggccggcaccgcgtcctccgcggccaggacgcggtgccacagcgcgccgaggcagcggaaggcgatggacgccgagcaggcgccgtcgccgaggacgggcgcctgctgccaagaaggggcgtcgaggaggtcgtgctcgcacgcgcacgcccgcgggttctgcttccagtgctcggaatcgacccgaacggacggattgtccgggatcagcgtcagcgacgaggtggttgccagagactactacctggacagcttttggtgatctgcgggcaacgtgatgcgaaactgctgggtccgtgcgctgtttgtgtagaagactaaggcacggatttgtacatactcgtagtcagtcatagacgctaaaacacctagcaaatcacggaacgagtggaagataacacgggatagccagacagcgagtcacagtctcacagaagagtgtatgtagatgctgaaacatacttgtacacacttgttgcttgggtgttggatggaagtgttctcatgtgaaggatgaagctaacagcattgtcagacagtggtactggctatatagttatgctgttatggtcaaaaaaaaaaaaaaaaa

SEQ ID NO: 96414 - protein, 406 aa, Zea mays
  misc_feature: Ceres CLONE 1667136
  misc_feature (88)..(108): Pfam Name: IQ Pfam Description: IQ calmodulin-binding motif
MRRVVRWLRQLLAGRKDERGGGLEVSHVGSGWSDGPEKEKKRWSFAKQRKSGGGGARSSGPDAVAPAAAVERSQLVGRPGEDARAREHRAAIAIQKTFRGYLARRALRALRSLVKIQALVRGYLVRKQATMTLHRLQTLMRLQADSIAVKNASYRRSMEQEERVYARDVQVKPLATAPAHRRMLSDSSDSIYERSPRIVEMDTCHLRSRSSRITSRYRYKYNPDGLPEYHHRHAAPTPSCSPLPARNGKHQPARLSFRQSARERDPRGSKTAQSTPRLASPHDSSSPAKSVEHSLASTPRRRPTAQRDRDRDALVSPRYMAGTASSAARTRCHSAPRQRKAMDAEQAPSPRTGACCQEGASRRSCSHAHARGFCFQCSESTRTDGLSGISVSDEVVARDYYLDSFW

SEQ ID NO: 96415 - DNA, 2716 bp, Zea mays
  misc_feature: Ceres CLONE 1667155
  misc_feature: Encodes the peptide sequence at SEQ ID NO. 96416
aagctttcttccagagtccaaaccaaacagcactccactctggtctcccaccattgatcccactccgtcccgggcccttgaaatggtttgatgcctgcaaccatgcccggtctctccagacgccgcctgctctgcttattcttgatcgcatgcctcgccgcccttcttttgtcgatcgccggcagcgccgggaagcccaaggaaactgacaatggcgacgccaagttcagagtgctgcgaggtatcgacactctcggccggatgcagaagcagcgtcacggccatggaatctctccggcctcagcgccggcgccggcggcggcgcgtgcccgcctacctctgctccacaaggatgcgcggctcccggtccccggaaaagtcacccacaaccataaaagaggaggaagtgcaacggcaccgaggcagagcccgccgcgcggcgggggaggcaaaggcgaaggcgaaggcgggagcaggaagaaaagtatgccgctggccgtcgtcgccgcggcggcggcgctgtccggggcggcgctggtgctcctcgccgtcctggtggtgttcctggcgtgcaagaagttgcagggcaagcgcgggggtagcggcgaccagagcggcggcaccaacaaggtgagcttcgagcccggcccgggcatgttctacctggacgccatcaagccgtaccttgacgacgccggccgcgacagtgaggggaaggcggcgccggagatcgccgcgcccaaggacgaggagcccaagcgcgatgacgaggaaggcgatggcgcttgctcagacgacgacggcgcccagtcggtccactcctcgtgctgcttccagtcctcgcatttctcctactccgagctcgcgaagggcggccaggccgacggcgtgtcgccgtcgccctccgtccgctccaagcggcggggctctgccccgacaacgccttcagacaaggcaaaggtcgcaagcccatattcgccactgggcccgcgcacgccgagcagtgaggaaaggggccgccgcacgcactccccgtcgagcacgtcggtgtccgtgttgacagagcagtcgttcaatgatcatgagatccagggaaccgctcattccgtcaggtctttgaaattccacggcggcggcgtgtgccacgcaaaagaagctggagcagagacagacgccgcaagtagaaaaacagtaccacctccgccgccgccgcctccgccaccaatgatggtaaaacagcagcagatcgttcagatgagctgtggtactctggccgtgcccgcgccgccgccaccgcccccaccgctgctaataccacaacgacagaatggtcagaggagcaacggccccaccctcccgccgccgcaggcaccaccgccgggactgttcaggcagactgcgcctgtgggcaagaacggcgcgccgctgcccaagctgaagcccctgcactgggacaaggtgcgcgctgcgcccaaccggcggatggtgtgggataggatccgctccagctcgttcgagctggacgaacagacgatcgagtcgctgttcggctacaacgccgccgctcggtgctcggtgaagctcgaggaaggccagggccggagcccctcgctcggacaccatgtcctggaccccaagaggctgcagaacatcaccatcctgatgaaggccgtgaacgccaccgccgaccaaatctacgccgcgctgctgcaagggaacggcctgtcggtacagcagctggaggcactgatcaagatggcgccgaccaaggaagaggtcgagaagctcgagagctacgacggcgacatcggcagccttgtcgcggcggaaaggctcgtcaaggtggcgctcacgataccgtgcgcgttcgcgcgcgtcgaggccatgctgtacagggagaccttcgccgatgaagtcatccacatcaggaagtcgttcgcggtgctcgaggacgcgtgcagggagctgatgtcaagcaagctgttcctgaagctgctggaggccgtgctgaagaccgggaaccggatgaacgtcgggacggcgcggggcggcgccatggcgttcaagctggacactctgctcaagctcgccgacgtcaagggcaccgacgggaagaccacgctgctgcacttcgtggtccaggagatggttcgctcccagaagccacccgcgcgcgctgcggaggggccggacatcgtgacggggctcgccgccgagctcaccaacgtcaggaagacggcgaccgtcgacctggacgtgctcaccacctcggtgtcgagcctctcgagcggcctgtcccggatcaaggcgctagtggggacggaccagctgctggcaggcgacgagaggggccagcgcttcgtcgccttcatggccccgttcgtcagccaggccgaggaggtgatcagggagctggaggatgacgagcgccgggtcctggcgcacgtcagggacatcaccgagtactaccacggcgacgtcggcaaggaggaagccagcccgcttcggatcttcgtcatcgtcagggacttcttggcgatgctggatagggtgtccaaggaggtgaggggagccaggggttgccacggatcaaaccaaacgctgccctgaacagcttgtgaccgatactgcagaaacggtgagagaacaacactgtaattcttggacttgggaagttagacatgtattcgttgtagttcaaaaaaaaaaaaaaaaa

SEQ ID NO: 96416 - protein, 839 aa, Zea mays
  misc_feature: Ceres CLONE 1667155
  misc_feature (440)..(819): Pfam Name: FH2 Pfam Description: Formin Homology 2 Domain
MPATMPGLSRRRLLCLFLIACLAALLLSIAGSAGKPKETDNGDAKFRVLRGIDTLGRMQKQRHGHGISPASAPAPAAARARLPLLHKDARLPVPGKVTHNHKRGGSATAPRQSPPRGGGGKGEGEGGSRKKSMPLAVVAAAAALSGAALVLLAVLVVFLACKKLQGKRGGSGDQSGGTNKVSFEPGPGMFYLDAIKPYLDDAGRDSEGKAAPEIAAPKDEEPKRDDEEGDGACSDDDGAQSVHSSCCFQSSHFSYSELAKGGQADGVSPSPSVRSKRRGSAPTTPSDKAKVASPYSPLGPRTPSSEERGRRTHSPSSTSVSVLTEQSFNDHEIQGTAHSVRSLKFHGGGVCHAKEAGAETDAASRKTVPPPPPPPPPPMMVKQQQIVQMSCGTLAVPAPPPPPPPLLIPQRQNGQRSNGPTLPPPQAPPPGLFRQTAPVGKNGAPLPKLKPLHWDKVRAAPNRRMVWDRIRSSSFELDEQTIESLFGYNAAARCSVKLEEGQGRSPSLGHHVLDPKRLQNITILMKAVNATADQIYAALLQGNGLSVQQLEALIKMAPTKEEVEKLESYDGDIGSLVAAERLVKVALTIPCAFARVEAMLYRETFADEVIHIRKSFAVLEDACRELMSSKLFLKLLEAVLKTGNRMNVGTARGGAMAFKLDTLLKLADVKGTDGKTTLLHFVVQEMVRSQKPPARAAEGPDIVTGLAAELTNVRKTATVDLDVLTTSVSSLSSGLSRIKALVGTDQLLAGDERGQRFVAFMAPFVSQAEEVIRELEDDERRVLAHVRDITEYYHGDVGKEEASPLRIFVIVRDFLAMLDRVSKEVRGARGCHGSNQTLP

SEQ ID NO: 96417 - DNA, 2375 bp, Zea mays
  misc_feature: Ceres CLONE 1667311
  misc_feature: Encodes the peptide sequence at SEQ ID NO. 96418
agcctattctcctcttctccagtcctgcctctgccctgaacctgaactaccagctccagacgagcagagccgcccacgagtcctccgcccccgcacatctcgtcaagactcgaggagccagccccacgaccgcctcggcctcgccccgcaccgcgatccccaactcccgcgcgccccgcgcggcatgccggccgacccaacctccggataaaccccccgccctgccgctcattttatggcgctcacgcgcgggcgcttgcgcgcgcgcactgcccacgccgtcgccagcgcctgcttcctcgtgctcctcctgctccttctgacctcctcctcactcttcgcgcccatcggccgcagcaacgcggcggagtccgacgagggcgggacaacagttctcggcgccgctccgtcgtcgtcgtcgtcgtcctcctcctcctccttgttcgggaaggggcgggggagcagctgcgaggagctgcagtccatcagcggcggggagggccggtgcgcgtacctccgcgcccactcgccctgctccccggccgggtacgtcgactacctccgcctcttctactgcggcttcgccggcgcgctgccggcggcggcgtgcgccgcgctcgcgctgtggctggtggtgctcttctacctcctcggcgacaccgcgtccgagtacttctgcgcgtcgctggagggcctctcggcggcgctgcgcctgccccccgccgtcgcgggcgtcacgctgctgtcgctggggaacggcgcgcccgacgtgttcgccagcgtcgtgtccttcgcgtcgggcgacggcggcgtggccggggtcggggtcgggctcagcagcgcgctcggcggggcgctgttcgtgtccaccgtcgtcgcgggcgccgtcgcgctcgccgccgtgggcgcgcgcggcggggtcgtcgtcgagtggcgcggcttcgtgcgcgacatctgcttcctcctcctcgcgctctgctacctgctggcggtgctcgtcagcggggagaccaccgtctgggtggccgcgtcgttcgtctcgctctacgccggatacgtcgtcctcgtctggacctcccactgctgcgccgagaagggcaagccggccgccgccgccggcctctccgcgccgctcctccgcgacgacgacgacgacggcagcccgtcgctgccgtcccactgctccaagacggagggcacgtccagggctagagcgatgctgcattgcgtcgcgggcgcgctctgcatgccgctgtacctgccgcgccgcctcaccatcccggacatcgccgggcaccgctggtcccggccctacgccgtggcctccgccgcgctggcgccggtcctcctcgccttcacgtggacctcgcagcgcgacaaccccttgtcgtcgcacagccttgctgtcctcgtgggcggcgcgctcctgggcctcctcctcgcggcgctggccgcggccagcacggacgccaggtcccctccgcgcgggcggaggcggcgcgtgccgtggctcgccgcggggttcgtgatgagcgtgctgtgggcgtacaccctggcgcgcgagctggtggcgctcctggtggccatcgggtacgtggtcgggatcaagccgagcgtgctgggcgtgacggtgctggcgtggggcgactccctgggcgacctggtgtcgaacgtggcgatggcggtgcacggcgggcccggcggcgcgcagaccgccgtgtccgggtgctacgcgggcccgctgttcaacacggtggtgggtctgggcctgtcgctggcgctggcggcgggcgcgcagcacccggccccgtttgcggtgcccgcggacgcggcggcgtacgaggcggtcgggttcctgggcgcggcgctggcgtgggcgctgttcgtggtgcccgtccgcgggatgcggatcgaccgcgtctacggggtggggctcatcgccatctacctctgcttcttcgccgtgcgcgtcctcgagacgctcgggctctggagctaggagccctccgccgcccgtggctgacacacttccttccccttgccggcgttcgtttcttgctactgaactgatgaatgagattggtagatctagattgacggtaaatgacagtacgagaaggatgaagggtagagataatcttgtatattactgtagtagtagtacatatgactatcctatagaagaggtcgcactactccctcacgtaggggttgattagtgtcctgacatagaatttgtgtttctttcgtcctcttgtgttttagaagggtttctcgtgtcctgacaattgtaagttgctgttcataagccctagtgtaagcagcatgttggttagcagtggaaaagaaagttgagaccaaaaaaaaaaaaaaaa

SEQ ID NO: 96418 - protein, 587 aa, Zea mays
  misc_feature: Ceres CLONE 1667311
  misc_feature (138)..(278): Pfam Name: Na_Ca_ex Pfam Description: Sodium/calcium exchanger protein
  misc_feature (435)..(578): Pfam Name: Na_Ca_ex Pfam Description: Sodium/calcium exchanger protein
MALTRGRLRARTAHAVASACFLVLLLLLLTSSSLFAPIGRSNAAESDEGGTTVLGAAPSSSSSSSSSSLFGKGRGSSCEELQSISGGEGRCAYLRAHSPCSPAGYVDYLRLFYCGFAGALPAAACAALALWLVVLFYLLGDTASEYFCASLEGLSAALRLPPAVAGVTLLSLGNGAPDVFASVVSFASGDGGVAGVGVGLSSALGGALFVSTVVAGAVALAAVGARGGVVVEWRGFVRDICFLLLALCYLLAVLVSGETTVWVAASFVSLYAGYVVLVWTSHCCAEKGKPAAAAGLSAPLLRDDDDDGSPSLPSHCSKTEGTSRARAMLHCVAGALCMPLYLPRRLTIPDIAGHRWSRPYAVASAALAPVLLAFTWTSQRDNPLSSHSLAVLVGGALLGLLLAALAAASTDARSPPRGRRRRVPWLAAGFVMSVLWAYTLARELVALLVAIGYVVGIKPSVLGVTVLAWGDSLGDLVSNVAMAVHGGPGGAQTAVSGCYAGPLFNTVVGLGLSLALAAGAQHPAPFAVPADAAAYEAVGFLGAALAWALFVVPVRGMRIDRVYGVGLIAIYLCFFAVRVLETLGLWS

SEQ ID NO: 96419 - DNA, 2163 bp, Zea mays
  misc_feature: Ceres CLONE 1667397
  misc_feature: Encodes the peptide sequence at SEQ ID NO. 96420
aaagattctgccaaaagatcctctcggatgcccccgcccccgcccacccatttcgccagtcgccatcgagctctcgcttccgccgcccgctgccgctctatcaccccggtgctgagccctaggatgtgactggcggacgtctctatggccgagccgtaggtggaggcggcacctcggcgccgtgggagatggaggacgatgacaccgagggtgtaggcgagagcacctgtccccccgccgccgaccgaggaggctcctcctcggccggcggcggcggcggcgactcgcacagttacactgacatagagaaggaggtcttcgaccgtctcatggagaagagaatcccggaggtcgtcgcggacccggtggccttccgcgaagagctccgccgccacttcgagcgcctgccgctgagctacgccgtcgatgtgaacgtcgacaaggcggaggacgtgctgctgcaccggaggattctcaacgagtgcgctcaccctgaaaatcgccccatcttccatgtgggcttcctgaactgcatcccgccctcggtggatccacagtataacactcagtccatctctacgagcgaaaacggtaattgtgggggttctcaggattccactttgagaaaatttgagccatgcgaagggatcgaggacctcagtttaactggacaaaaagttgtggttgactctgtggccagttcttcgaggggagatgaagaaatcctccatgttcatgaaattattttttctaccattgacaaaccaaagctcctcgctcagctatctgctttgttgtctgaagttggactgaacatccgtgaagctcatgtcttctcaacgactgatggcttttgtttggatgtatttgttgttgatggctgggatacaaaggagacagatactttgctacagattctcaaggagacagcggcacgaaatcatgcctcattatcaaacccaaccaattctgcagcctcagaaagagtactggaactacaagagaagattggtgattcaaatattgacaggaattttctgcagattggggagaagattgcatctggatcttccggggacttgcatcgaggaacttatcaaggtatggatgttgcagtaaagttcctcagaaccgaacatgttaatgactcgtcaaaggtggagtttttacaagaaataattattctaaagagtgttaatcatgataatgttgttcgattctacggggcatgcacaaagcagagaaaatatgtcatcgtgacagagtatatgcctggaggcaatctgtatgattttcttcacacgctaaaaaatactttggatctcccaacggttctcaggattgctatcggcatctccaaggggatggattatttgcaccaaaataacatcatccatcgggacttgaagactgccaatttgcttatgggctctgattatgttgtgaagattgcagactttggagtctcaaggaatccatctcaaggtggagacatgactgctgaaactggtacctacagatggatggcacctgaggtaataaaccataagccgtacgatcacagggcagatatcttcagctttgctgtggttctgtgggagctggtcacttcaaagataccatacagaaatctgacacccttgcaagctgcactgggagtaaggcagggaatgcggttggagatcccgtcatgggtcaatccacaactgtctaaactgattcagcgttgctgggacgaaaatcctaacctgcgcccctctttctcagagatcactgcagagctggaaggcatgttaagggatcatcaggcctccaagggaagcaacaaacattcgaaggcaaaggcacacaaaaaatcgcagagagaggcagaataacgaggttgtcagttaccaccttgtgaaaagcttagtggagcttggctatcatcgtccaagattctgaggctactacaaagatgctgctagtgtacaattgtcaaatattgtatatgattggtgtgtgtgtgtgtttctattactcccaaaaacactatatacgggagaagcgtcgacaatacagcgggacaagcaaagacacggaatccttgtacaaaatggcttgcaagcagcataaaatgccctctagtttttgtatacaaaacatgaaaaaaaaaaaaaaaaa

SEQ ID NO: 96420 - protein, 562 aa, Zea mays
  misc_feature: Ceres CLONE 1667397
  misc_feature (284)..(532): Pfam Name: Pkinase_Tyr Pfam Description: Protein tyrosine kinase
  misc_feature (183)..(249): Pfam Name: ACT Pfam Description: ACT domain
  misc_feature: SWISSPROT Homolog: EC 2.7.11.1 Non-specific serine/threonine protein kinase
MEDDDTEGVGESTCPPAADRGGSSSAGGGGGDSHSYTDIEKEVFDRLMEKRIPEVVADPVAFREELRRHFERLPLSYAVDVNVDKAEDVLLHRRILNECAHPENRPIFHVGFLNCIPPSVDPQYNTQSISTSENGNCGGSQDSTLRKFEPCEGIEDLSLTGQKVVVDSVASSSRGDEEILHVHEIIFSTIDKPKLLAQLSALLSEVGLNIREAHVFSTTDGFCLDVFVVDGWDTKETDTLLQILKETAARNHASLSNPTNSAASERVLELQEKIGDSNIDRNFLQIGEKIASGSSGDLHRGTYQGMDVAVKFLRTEHVNDSSKVEFLQEIIILKSVNHDNVVRFYGACTKQRKYVIVTEYMPGGNLYDFLHTLKNTLDLPTVLRIAIGISKGMDYLHQNNIIHRDLKTANLLMGSDYVVKIADFGVSRNPSQGGDMTAETGTYRWMAPEVINHKPYDHRADIFSFAVVLWELVTSKIPYRNLTPLQAALGVRQGMRLEIPSWVNPQLSKLIQRCWDENPNLRPSFSEITAELEGMLRDHQASKGSNKHSKAKAHKKSQREAE

SEQ ID NO: 96421 - DNA, 2060 bp, Zea mays
  misc_feature: Ceres CLONE 1668278
  misc_feature: Encodes the peptide sequence at SEQ ID NO. 96422
actcgattcactccacgcgccaaacttagcatccctctcctcccgcctcctctccaccggtatcggtgtcctcctccggtcccccctccctctgggaaggcccttggatctctcgatctccaaggcctgccttccattgccatagccatcgaccgtcgttctcgcctcgtggtggtctcgtgcccctctccggtcgcctgagcaacccaccactagtctggtcacgctcccctgctccgcaccggacgggcgggtttcatttggtgcgcgtgcggcgagctcgggcatggcgttccacgaagtggagacgccgcgtcgatgctgagacgccggggcatggtcggcgcgcagtgacggcggccggcggctcggtccgtgcgtgcgtgcccagcattcttgcccctgtcgagtcatcggctcgtcgctcgctcgcgcccacgccgctcgccccgcgtccacagggtcgccgccacggggaggcgcagagggaaaaggaagatgagctgctttccgtgcttcggcggcggaaagggcaacaacgacgacgccgacgcggagagcccgggcgacgcggccccggcgtctaacatgacgccgcccgcgatggtgcaggcgcccgccgcgtacttcccagctcccgccgccgctccaacggccgcggcgccgcccaagcccggtggcgggaaccaggcgcacgaggcttccgccgatgactcggcgctgcggctcgccatcacggggcaggcgttcgcgttccgcgagctcgccgccgccacagaccacttcacgccgtacaacctcgtcggtgaaggcggcttcttccgggtctacaagggccggctagagaagagcgggcagaccgtggccatcaagcagctggacaagcatgggttccaggacaacaaggcgttcttgaccggggtcgccaagctcagccagctccaccacgagaacctcgtcgacatcattggctactgcgctgacggagaccagcggctgctggtgtacgagtccgtgcccgccggcaccttagaagaccacctgttcgatctgccggcggacaagaagccgatggactggtgcacgaggatgaaggtggcgcacggcgccgcgcaggggctggagtacctgcacgagacagcgaacccgccggtggtgtacggggaattcaaggcctcccacatacttctcgacgagaagctcacgcccaagctctccgacttcgggctcgcgcagctcggccaggccgggggcagcatgccggtggtggcgtcgcccatgatgggctccttcggctgctgcgcgccggagtacgatcgcaccgggcaggccaccatgaagtccgacgcgtacagcttcggggtggtgctggtgcagctcatctccgggaggagggccgtcgataccagcaagccggtggacgagcagaacgttgtcacctgggccatgccgatgttcaaggaccagaagagataccatgagctggttgatccactcataaagaaggaataccctgccaaagcgttgaaccaggtggtcgccatggctgcgatgtgcttgcaggaagaggactccgtgcgaccgctgatggccgacgtcgtcatgacgctaggcttcctcacggcgatgccgcctgacccaccggcccctgccgctccaccacctgccgccgccccggagtcgaaggaagacaaagaatcggaccattcagactcctcgtcatcttcttcttcagacgacgacgaagataacgaggaggaggaaaccgaggagcaatgataagggcgggtgtgttcaacttcgaaggcttcaaacgtggaagggacacacagatgaagtggcttcgtgccgtgtacacggagctcaatatgtgggaccttggagccacttggacttggtggttgtgggctgtggcagttaaattggggtgttcacaagtgagtaatctttttttttgtgatgacgccaagcatgtaaaaatgtgagctatgacatactgatgggttacacaatttgcactttaatctgcttttcttatggccgaaaaaaaaaaaaaaaaa

SEQ ID NO: 96422 - protein, 426 aa, Zea mays
  misc_feature: Ceres CLONE 1668278
  misc_feature (96)..(371): Pfam Name: Pkinase_Tyr Pfam Description: Protein tyrosine kinase
  misc_feature: SWISSPROT Homolog: EC 2.7.11.1 Non-specific serine/threonine protein kinase
MSCFPCFGGGKGNNDDADAESPGDAAPASNMTPPAMVQAPAAYFPAPAAAPTAAAPPKPGGGNQAHEASADDSALRLAITGQAFAFRELAAATDHFTPYNLVGEGGFFRVYKGRLEKSGQTVAIKQLDKHGFQDNKAFLTGVAKLSQLHHENLVDIIGYCADGDQRLLVYESVPAGTLEDHLFDLPADKKPMDWCTRMKVAHGAAQGLEYLHETANPPVVYGEFKASHILLDEKLTPKLSDFGLAQLGQAGGSMPVVASPMMGSFGCCAPEYDRTGQATMKSDAYSFGVVLVQLISGRRAVDTSKPVDEQNVVTWAMPMFKDQKRYHELVDPLIKKEYPAKALNQVVAMAAMCLQEEDSVRPLMADVVMTLGFLTAMPPDPPAPAAPPPAAAPESKEDKESDHSDSSSSSSSDDDEDNEEEETEEQ

SEQ ID NO: 96423 - DNA, 1696 bp, Zea mays
  misc_feature: Ceres CLONE 1668495
  misc_feature: Encodes the peptide sequence at SEQ ID NO. 96424
agtgctctaatcaaaaatcaaacaaaccagaagctcctcctcgcctcccatcacttcctacgccacccgcgaagcgcgcccgaggcggcaccccaccgtcgtagtagaagacacgggacgcacccccgcagcctcgctcgctcgctcccctcacttcctccccgcgcgatccacggcccccgccccccgcgctcctgtctgctctccctctccgcaatggcgacgccctcggccgtgggcgccgccctgtcggagatggcgccggcccggctccgcggcgcgttcagcaacgggttccagctcagcgtcggggtcggcgcgctggcggcgaacgtgatcaacttcggcacggagaagatcggcggcggctggggctggcgcgtgtcgctggcgctcgccgccgtgcccgcggggctcctcaccctcggcgcgctgttcctcccggagacgcccagcagcctggtgcagcaaggcagggaccgccgcgacgtggcgcggctgctgcagaaggtccgcggtgccggcgtcgacgtgggcgacgagctggacgacatcgtcgccgcgggtgagtctgcggccggagccggagggggcggcctgcgtcggctgctcgtggagcggcggtaccgccctcagctggtgatggcggtggcgatccctttctttcagcaggtgacggggatcaacgcgatcgcgttctacgcgccggtgctgctgcgcaccatcggcatgggcgagagcgcgtcgctgctgtcggcggtggtgacgggcgtcgtgggcgtggcctccacctccgcgtccatgctcgccgtggaccgcttcgggcgccgcacgctgttcctggccggcggcgcgcagatgctggcgtcgcaggtgctgatcggcgccatcatggccgcggagctgcgggacagcggcggcgtggggaaggcctgggcgggggtgctcatcctgctcatcgccgtgtacgtggccgggttcggctggtcctggggccccctcgggtggctggtccccagcgagatcttcccgctggaggtgcgcgccgccgggcagagcgtcacggtggcggtgagcttcgcgttcaccgtgttcgtggcgcggacgttcctgtccatgctgtgtcacatgaaggccggcatcttcttcttcttcgccgcgtggctcgccgtcatgaccgccttcgtgtacctcctgctgccggaaacgaagggggtgcccatcgagcagatggccggggtgtggcgcgcgcactggttctggagcagggtcctggggccggagtcggaccccgacacagacgagggccgcgcgcgcgggaaactataacgcggatgcaacgaacagaaccatatgagtgtggtgtgtggcaggggactctgaattcgaaaaggggaggaaggccaagcaaactagacggcctcaggtgacttgaaagaaaacagacagtattcagacaagttctgtgagccttcattcatcaagtgaaaattgcaggatcatcataaccatgcaggttgcagatgcagccccaagctacgagatgtcagaccgcagcacatatacaagaacctgctggaggcctgttcccaaaacgcttatactattactactgcgaattcacagatccttggattattcatacgtgatcaatttcatttcggctcccttccgattctaaaaaaaaaaaaaaaaa

SEQ ID NO: 96424 - protein, 370 aa, Zea mays
  misc_feature: Ceres CLONE 1668495
  misc_feature (1)..(343): Pfam Name: Sugar_tr Pfam Description: Sugar (and other) transporter
MATPSAVGAALSEMAPARLRGAFSNGFQLSVGVGALAANVINFGTEKIGGGWGWRVSLALAAVPAGLLTLGALFLPETPSSLVQQGRDRRDVARLLQKVRGAGVDVGDELDDIVAAGESAAGAGGGGLRRLLVERRYRPQLVMAVAIPFFQQVTGINAIAFYAPVLLRTIGMGESASLLSAVVTGVVGVASTSASMLAVDRFGRRTLFLAGGAQMLASQVLIGAIMAAELRDSGGVGKAWAGVLILLIAVYVAGFGWSWGPLGWLVPSEIFPLEVRAAGQSVTVAVSFAFTVFVARTFLSMLCHMKAGIFFFFAAWLAVMTAFVYLLLPETKGVPIEQMAGVWRAHWFWSRVLGPESDPDTDEGRARGKL

SEQ ID NO: 96425 - DNA, 2487 bp, Zea mays
  misc_feature: Ceres CLONE 1670438
  misc_feature: Encodes the peptide sequence at SEQ ID NO. 96426
aattcggtgaagctcactccctcacccaacgctccatagtccacactcgccgtgctccccatgcagcaaccgcttgtgctcctccttctcttcttcatcggctcggccaagtatgccgtcgcctcccgcgccgacgccggtgcggctacctacattgtctacctgaaccccgcgctcaagccgtccccctacgccacgcacctccactggcaccacgcgcacctcgacgccctctccctggaccccgcgcgccacctcctctactcgtacacgaccgccgcgccgtccgcgttcgccgcccgcctcctcccatcccacgtggcggcgctcaccactcaccctgccgtcgcgtcagtgcacgaggacgtgctcctgcctctccacaccacgcgctccccatcgttcctccacctcccgccgtacagcgcgcctgacgcggacgccgggggcccggacgtcatcatcggggtgctcgacaccggcgtctggcccgagagccccagcttcggggacgccggtcagggccctgtgcctgcgcggtggcgcgggagctgcgagaccaatgccaccgacttcccgtcctcgatgtgcaaccgcaagctcatcggcgcccgtgccttcttccgcggctactcgtcgggggccggcgacggctctcgagtcggcgccgacctaatgtcgccgagggaccacgacgggcacggcacgcacaccgcgagtacggcagccggggccgtcgtggcgggcgcaagcctcctcgggtacgcgccgggcacggcgcggggcatggcccccggggcgcgcgtcgcggcgtacaaggtgtgctggaggcaagggtgcttcagctccgacattctggcgggcatggagaaggccatcgacgacggcgtcgacgtgctctcgctgtcgctgggtggcggcgcgttcccgctctcgcgcgaccccatcgcggtcggcgcgctcgcggccacccgccgcggcatcgtcgtctcgtgctccgctgggaacagcgggccgtcgccgtcgtctctggtgaacacggccccgtgggtaatcacggtcggcgccgggacgctcgaccggagctttccggcttacgcccagctcgccaacggcgagacccacgccggcatgtccctctactccggcgatgggctcggtgacggcaagatccctctggtgtacaataagggcatccgtgccggcagcaactcgagcaagctctgcatggagggcacactgaacgccgcggaggtgaagggcaaggtggtcctctgcgacaggggcggcaactcgagggtggagaaggggcagatagtgaagctagccggtggcgtgggaatggtgcttgcgaacaccgcccagagcggcgaggaagtcgtggcggacagccacctgctcccggcggttgccgtcggcgctaagagcggggacgccataaggaggtacgtggagtcggacgccaacccggaggtggcgttaacctttgccggcaccgcgctcgacgtgcggccggcgccggtagtagccgcgttcagctcccgtggacccaacagggttgtgccgcagctactcaagccggacgtgatcggcccgggcgtgaacatccttgccgggtggacggggtccatcgggccgaccgggctagccgccgacgagcggcggtcagagtttaacatcttgtcagggacatccatgtcgtgcccgcacatcagcggcctggcggcgttcgtgaaggcggcgcacccggactggagccccagcgccatcaagtccgcgctcatgacaactgcctacaccacggacaacaccgggtcgcccctcctcgacgccgcgaccaacaccacggccacgccgtgggccttcggcgcgggccacgtggaccccgtcagcgcgctctccccgggactcgtctacgacgcctccgtcgacgactacgtcgccttcctctgcaccgtcggcgtcgcgccgcggcagatccaggtcatcacggcggaggggcccaacgtgacctgcacgcggaagctgtccagcccaggggacctcaactacccgtccttttcggtcgtgttcgaccggaggtcgtcgcgcagcaccgtgaagtaccggcgcgatctgaccaacgtcggcagcgccggggacacgtacactgtcaaggtcaccggacccagcgacatcagcgttagagtcaagccggcaaggctcgagttcaggcgggccggagacaagctcaggtacaccgtcacgttcaggtccgcgaacgccagaggacccatggaccccgctgcgttcggttggctgacgtggagcagcggtgagcacgatgtgcggagcccgatatcgtacacttgggggatgtagcactgatctccacagctgatccgagcatttatcttaccgccggagtgaattgggtctcagggatgccggaaatatatatcttcaataatgatacgaattcgcttgttagaaaaaaaaaaaaaaaaa

SEQ ID NO: 96426 - protein, 766 aa, Zea mays
  misc_feature: Ceres CLONE 1670438
  misc_feature (364)..(464): Pfam Name: PA Pfam Description: PA domain
  misc_feature (29)..(108): Pfam Name: Subtilisin_N Pfam Description: Subtilisin N-terminal Region
  misc_feature (111)..(593): Pfam Name: Peptidase_S8 Pfam Description: Subtilase family
  misc_feature: SWISSPROT Homolog: EC 3.4.21.25 Cucumisin
MQQPLVLLLLFFIGSAKYAVASRADAGAATYIVYLNPALKPSPYATHLHWHHAHLDALSLDPARHLLYSYTTAAPSAFAARLLPSHVAALTTHPAVASVHEDVLLPLHTTRSPSFLHLPPYSAPDADAGGPDVIIGVLDTGVWPESPSFGDAGQGPVPARWRGSCETNATDFPSSMCNRKLIGARAFFRGYSSGAGDGSRVGADLMSPRDHDGHGTHTASTAAGAVVAGASLLGYAPGTARGMAPGARVAAYKVCWRQGCFSSDILAGMEKAIDDGVDVLSLSLGGGAFPLSRDPIAVGALAATRRGIVVSCSAGNSGPSPSSLVNTAPWVITVGAGTLDRSFPAYAQLANGETHAGMSLYSGDGLGDGKIPLVYNKGIRAGSNSSKLCMEGTLNAAEVKGKVVLCDRGGNSRVEKGQIVKLAGGVGMVLANTAQSGEEVVADSHLLPAVAVGAKSGDAIRRYVESDANPEVALTFAGTALDVRPAPVVAAFSSRGPNRVVPQLLKPDVIGPGVNILAGWTGSIGPTGLAADERRSEFNILSGTSMSCPHISGLAAFVKAAHPDWSPSAIKSALMTTAYTTDNTGSPLLDAATNTTATPWAFGAGHVDPVSALSPGLVYDASVDDYVAFLCTVGVAPRQIQVITAEGPNVTCTRKLSSPGDLNYPSFSVVFDRRSSRSTVKYRRDLTNVGSAGDTYTVKVTGPSDISVRVKPARLEFRRAGDKLRYTVTFRSANARGPMDPAAFGWLTWSSGEHDVRSPISYTWGM

SEQ ID NO: 96427 - DNA, 1450 bp, Zea mays
  misc_feature: Ceres CLONE 1670674
  misc_feature: Encodes the peptide sequence at SEQ ID NO. 96428
agtgctagactgtcatcccttcctccttccccacgcgtacacactcccacggcggcagccaccatcccggagctcgagaccagcggccagcggcaccaggagggtgacgggcccgcgactcagtcgagcgccactcccatggcggacaagatctccacgatcgtcctcaaggttgaccttgaatgcgagagatgctacaggaagatcagaaaagtcctctgcaagatccaagacaagatgaacatcaagacgatctcgttcgacgagaagagcaatgccgtgaccatctccgggccgttcgacgccgacacggtctgcaacaagctctgctgcaaggccggccgggtcatcaaggcgatggacgtcaagggcaaggagaaggacggcggcaaggccgggaaggagggcggcggcgacaagcccaaggacgccgccaaaccggcggcggccgagaaggacgccggtaaggccgggaaggagggcggcgccaaggcggagaagaaggaggagaaggccgagaagaaggaggagaaggccgataagaaggaggggggcaagggcgacaaggaggcgaagccggagaagggcaacaaggacgggaaggcggaggcaaagaaggtgaagttcgccgaggtccccgcggcggacgcgaagcccggcaaggccatgccgcccggcatgaccaaggccgacctgggcccgctcctggagaagatgatggcggccaaggccgggcccgagccgcagccgatcgcgccgccgccggcgatggcgccgggcgccgcgcagggcgtggccgtgccgtccgtctggcccgcgcccgccgggtccgtgtccggctacggctacggctacaacccgggctacgaggcgccgccgccgtcctactacgccgctggcgccgggggcggctacggctgcggctgcggcggctacaacggctactgccggtgcggcaagccggccgcgcccgggcccggcgggtactacggcgtgccggtgtacgatagccaggggtggtactacggcggtggcggcggcgcccggcagccgtactacccgcagcagcagcagcagcagcagcactgctgcgaggaccccaatgccgggtgcagcgtcatgtgatggcgatgcccgccagcccgtggattggatggacagacagacagagcaatcagtgtgtggtcacagtcacactaccatggccagtgccggagtcggggagaaaggaacttctattttttcccgcgtgtcgtcttgttcttgtttgtgccccgtggattccgtttatttatttattttagggagttgagttgtgcatgtgaacagtcgatgcttatggtgtctatctagtgtgggtgatgaaagtataacgacagtacagtaccagtagtttgtttagatgaaagcatggaacaccttgagtgctcttgaaaaaaaaaaaaaaaaa

SEQ ID NO: 96428 - protein, 328 aa, Zea mays
  misc_feature: Ceres CLONE 1670674
MADKISTIVLKVDLECERCYRKIRKVLCKIQDKMNIKTISFDEKSNAVTISGPFDADTVCNKLCCKAGRVIKAMDVKGKEKDGGKAGKEGGGDKPKDAAKPAAAEKDAGKAGKEGGAKAEKKEEKAEKKEEKADKKEGGKGDKEAKPEKGNKDGKAEAKKVKFAEVPAADAKPGKAMPPGMTKADLGPLLEKMMAAKAGPEPQPIAPPPAMAPGAAQGVAVPSVWPAPAGSVSGYGYGYNPGYEAPPPSYYAAGAGGGYGCGCGGYNGYCRCGKPAAPGPGGYYGVPVYDSQGWYYGGGGGARQPYYPQQQQQQQHCCEDPNAGCSVM

SEQ ID NO: 96429 - DNA, 1278 bp, Zea mays
  misc_feature: Ceres CLONE 1671372
  misc_feature: Encodes the peptide sequence at SEQ ID NO. 96430
ttacccttccccacactgctgcgccgcgcagtcttctgcttctccccaccctcgcctcagcttccctgccgttccctccgatcaccagctgctgagtgctgagccaagaaccatcgcgtttcattgttcgagtccttgctcagtctcatacatgttcctcttctttgtgcttgctgctatagattttcaactattgttcacgtgcagggtagcgatgaagatcttgaaccagctcatcagcccaggcggccacccggtgtcgttcccgccggcggcggccaaggagagcgggcatctcgtgccggcgcagccgaccaccacggcggccgcggggcggtcccatgcgcactgccctcggtggcaggcgcagacgctgcgccgggccagcagctacgtcggcgtcgagcacatcgacgggaccaccgcgtccgtcccagtcccagtcccagtcccagtcgcggccccgttcaagccgctcacgctcgacttcctgcggtcgctcctggaccggaactgcagcatggcccccgccgtcccggacggggaggccagcgccccgccgccgccgcagatggtcgcgctccgggtgctggtgacctccgccgtggagctggacgcgcgccaggccgagcgcatcgcgcgcaagatgcgccgcctcaccggctttgtcgacctcaaggtcgagaccgccgtggacgcgtccctcatcgccggcttcgtcgtctgctacggcaccgacgactcgcacgtcatcgacctcagcgtcaggggccagctcgcggcgctcaagagccgcgtcgactccatcgaccagaccgcgcatgcccacggacacccacaccaccactgaccgtcgatccaacaccagatgcaccggagcaaagcacagcgcgccgtcaccgtgctacagcttacaatacaagcctatactgtacacgcacagaatgacagaaccgaacgcgcgccatggcaacaacagttttcctatgtaatgttgttgtaaatcgatagcgagaaaacttaattgctgctaccttccttcctgctgagcttgtatacgtttctattgctaaagaaacgaacgctattgattgtatatttgatcgatgtggagacagcatgcagcctctatggtgtaaagtctaatatgctattgcaaggttgaagtttgtatatggaggatcaggcttcaggcctgcagcattgtaatggactccatgaccatgaaaaaaatggctaagagtgcgttcgtttgttcaagaaaaaaaaaaaaaaaaa

SEQ ID NO: 96430 - protein, 232 aa, Zea mays
  misc_feature: Ceres CLONE 1671372
  misc_feature (58)..(216): Pfam Name: OSCP Pfam Description: ATP synthase delta (OSCP) subunit
  misc_feature: SWISSPROT Homolog: EC 3.6.3.14 H(+)-transporting two-sector ATPase
MFLFFVLAAIDFQLLFTCRVAMKILNQLISPGGHPVSFPPAAAKESGHLVPAQPTTTAAAGRSHAHCPRWQAQTLRRASSYVGVEHIDGTTASVPVPVPVPVAAPFKPLTLDFLRSLLDRNCSMAPAVPDGEASAPPPPQMVALRVLVTSAVELDARQAERIARKMRRLTGFVDLKVETAVDASLIAGFVVCYGTDDSHVIDLSVRGQLAALKSRVDSIDQTAHAHGHPHHH

SEQ ID NO: 96431 - DNA, 906 bp, Zea mays
  misc_feature: Ceres CLONE 1671428
  misc_feature: Encodes the peptide sequence at SEQ ID NO. 96432
agacctcgtcgccggcgcgctagctctctgtcgatggaaaattcgccgctccacggaggaatctgccaacaaccaaacactcagctggctacggcttcgtgcctgcttgccccgctgccgccggtcgtagccgagccacagccggagcagcagcatgcgtgcaccgatgcgccgccgacgtctgttgcccctggcgcggcgatgagttgcccgccgccgacgtctgttgcccctggcgcggcgatgagttgcccaccgccgccggctgccgttgactgggcgtcgctgcttctaccgcccagcacgtcgggcgcgagcgaggtcgacagcggtgtcagcgttgtgacgacggtggccgggagcagagctggtgcgacggcgggagagggagataatagtaaggccggaaaagctgggaagcagggcggcgggagggggaagaacaaggtgagccggccacggttcgcgttccagacgcggagcgagaacgacatcctcgacgacggctaccggtggaggaagtacgggcagaaggccgtcaagaacaccgcatttccaaggagctactaccggtgcacgcaccacacgtgcgacgtgaagaagcaggtgcagcggctggccaaggacacgagcatagtggtgaccacgtacgagggcgtgcacaaccacccgtgcgagaagctcatggaggcgctcagccccatcctcaaacagctccagctcctctctcagctccagtcttgcactaatcaactcctctgaatatcgatgtgtggcccagccatcatcagtgtttaactaatgcaaatttactgctaagtgtacaaaacaaactcacatgatgacttcgtttcaagtacccataaaatattattagttgttccgtgataaaaaaaaaaaaaaaaa

SEQ ID NO: 96432 - protein, 242 aa, Zea mays
  misc_feature: Ceres CLONE 1671428
  misc_feature (155)..(214): Pfam Name: WRKY Pfam Description: WRKY DNA -binding domain
MENSPLHGGICQQPNTQLATASCLLAPLPPVVAEPQPEQQHACTDAPPTSVAPGAAMSCPPPTSVAPGAAMSCPPPPAAVDWASLLLPPSTSGASEVDSGVSVVTTVAGSRAGATAGEGDNSKAGKAGKQGGGRGKNKVSRPRFAFQTRSENDILDDGYRWRKYGQKAVKNTAFPRSYYRCTHHTCDVKKQVQRLAKDTSIVVTTYEGVHNHPCEKLMEALSPILKQLQLLSQLQSCTNQLL

SEQ ID NO: 96433 - DNA, 1042 bp, Zea mays
  misc_feature: Ceres CLONE 1672778
  misc_feature: Encodes the peptide sequence at SEQ ID NO. 96434
agagtggagtgggagagcgcgaagttaagccaccatgtggacgagggctttagcgatgatgctgttcgtggcaggcgccgcgctgctcggcgtcggcggcgccagcgcgcagcagggcgtgtggaacatcatcactcgtcccatgttccagagcatgctgagccaccgcggcgacagcgggtgccagggcgccttctacacctacgacgcgttcatcgaggccgccagcaagttccccggcttcggcaccaccggcgacgagcagacgcgcaggcgggagctcgccgccttcttcggccagacgtcccacgaaaccaccggtggatgggcgactgctcccggtggaccgtttgcctggggatactgccgggtgaaggaacagaacccgacggacccaccctactatggacgaggacccatacagctaactcatgagtacaactacaggctcgccgggcaagcgctgaacctgaacctggtgggcaacccggacatggtggcgagcgaccccgtggtagccttcaagacggccatctggttctggatgacgccgcagtcgcccaagccgtcgtgccacgccgtgatgaccggcgcctggacgccgtccgccaccgaccgcgccgccgggaggctccccggatatggcctcacctcgaacatcatcaacggcgggctagagtgcggcaagggccagtccaccgacggcgccaaggaccggggtggctactacaagaggtactgcgatatgctccgggtggggtacggggacaacgtgccctgcaaggaccagaagccttacggaggatgaggacgtggacaacaataattatatggttgctgcaagccttcacgtgtttttgttgcctctctaccaactaagaataaatcaagctagcagcaaacaggggcaacctgctaccttcggcatgtgtctacttatcatatagtgtgtctatgtatggcacagtatctcatctctggatgcatgataacgaactaatcaacggttagcagcattcacctttaaaaaaaaaaaaaaaaa

SEQ ID NO: 96434 - protein, 257 aa, Zea mays
  misc_feature: Ceres CLONE 1672778
  misc_feature (32)..(249): Pfam Name: Glyco_hydro_19 Pfam Description: Chitinase class I
  misc_feature: SWISSPROT Homolog: EC 3.2.1.14 Chitinase
MWTRALAMMLFVAGAALLGVGGASAQQGVWNIITRPMFQSMLSHRGDSGCQGAFYTYDAFIEAASKFPGFGTTGDEQTRRRELAAFFGQTSHETTGGWATAPGGPFAWGYCRVKEQNPTDPPYYGRGPIQLTHEYNYRLAGQALNLNLVGNPDMVASDPVVAFKTAIWFWMTPQSPKPSCHAVMTGAWTPSATDRAAGRLPGYGLTSNIINGGLECGKGQSTDGAKDRGGYYKRYCDMLRVGYGDNVPCKDQKPYGG

SEQ ID NO: 96435 - DNA, 1040 bp, Zea mays
  misc_feature: Ceres CLONE 1672916
  misc_feature: Encodes the peptide sequence at SEQ ID NO. 96436
acttcgattcgctcccacgcacacacactcctgcctgcggttgccactcgcgtagcaccagacagcggcagcagcacgcgcgcgacgttcgcaatggcggcgcgggcaaccgtcgtcctctgcgccgcgttcctcgtcctgctctccgccaccagctccctcgcgcagtcccccgcggccgcgccggctaaggcgccgcccaagtcctcctccaaggccacgccggccgccgcgcccgcgcccaagtcctcctccaaggccagcccattggcgccggccgccgcgccaaccaccccggcacccgcggcggcgccggccacgccaaagcccaaggcccccgcgcccgcgcccgccaccaaggccgcagccccggccccggctacccctgctcccgtcgccactccccccgcggcgacgcctcccgccgccgaggcgcccgtgcccgccgcggcgccggcccccgagaccaagcccgtcgaggcccccgcccccgcccccgcgccggccaagaagaagaagccgtcgtccccctcctccaaggacaagaagaagaagaagggcgcgtccgcccctgccccggccgccgacgcccccgtcgccaagaagcccagaaccgccgacgcgcccacgtccgcagccgaggctcccgggcccagcggcgacgccgccgctgccgacaccgcgagggccgcagcgaggaggacaccggcgggcgtgatcgcgtcgtcggccgtcgcggtgctgctgggtgcggcggccctgctcgcctagataagatccccggatgccaccatcacaggatttgatgcccttttcctgcttttactttttctttcgctattttgtggaaaaaaggggttttcttctgtgtagtagagtagtaccgtagcagtagactagtagggcggatgatttcttctgcttccagagatgatacgagagagagagtggttagagtagagaggggactgcccgagtaatgttcagatttatctacatatttatatatccctgttatagctcaaaaaaaaaaaaaaaaa

SEQ ID NO: 96436 - protein, 225 aa, Zea mays
  misc_feature: Ceres CLONE 1672916
MAARATVVLCAAFLVLLSATSSLAQSPAAAPAKAPPKSSSKATPAAAPAPKSSSKASPLAPAAAPTTPAPAAAPATPKPKAPAPAPATKAAAPAPATPAPVATPPAATPPAAEAPVPAAAPAPETKPVEAPAPAPAPAKKKKPSSPSSKDKKKKKGASAPAPAADAPVAKKPRTADAPTSAAEAPGPSGDAAAADTARAAARRTPAGVIASSAVAVLLGAAALLA

SEQ ID NO: 96437 - DNA, 1512 bp, Zea mays
  misc_feature: Ceres CLONE 1674059
  misc_feature: Encodes the peptide sequence at SEQ ID NO. 96438
aacgtttcaagaaccactcctccgtcacccccctcacaagccttgcttgtagtcgtagctactagcctcaacaactaacaccacacgacccactccattactacttagtttttcccttccttcgcagaccatcacctccatccagctccaggctcgctcgctcttctcccatggccgcaggagctgcctccacgggcaactggtcgcgtgcgaccggcgcaatgcgtgcggccatggtattgtgggtttgtttggcttacatgcgcggtgtgtgcgaggactggtcgccattgcggctgctggtgctcttggtggcggcgacgctggtggcgaggtggttcctaaacgccgtgcggccgcctccctcgacgccgtgcggcacgcccgggggcccgccggtgacggcgcccagggtgcggctgcgcgacgggcggtacctggcgtacgcccagtccggcgtgagcagggacagggcgcgcttcaaggtggtgtactcgcacggcttctccggcagccgcatggactcgccccgcgcttcccaggagctgctggaggagctgggcgtgtacatggtggcgttcgaccgggccgggtacggcgagagcgacccggacccgcggcggtcgccggagagcgcggcgctggacatccaggacctggccgacgcgctgggtctgggtgacaagttccacctcgtctgctcctccctcggttcccacgccggctgggccgccgtcaggtacatcccgcacaggctggcggggctggcaatgatggcgccggtcatcaactaccgctggcgcgggctgccgcgggggctggcccggcagctctacgggaggcagccggtcggcgaccagtggtcgctccgggtcgcctactacgcgccgtggctgctgcactggtggatgagccagccgtggctgcccacctccaccgtcgtcgacggctccgcgcccttccccaacgcgctggacgagaagaaccgcgtcatggcgctctccaactgcatgttccactcgagggcgaggctggcgacgcagcagggcgtacaggagtccttctaccgcgacatgacggtcatgttcgggaggtggacggacttcgagccgacggacctcgagaagccgccgtttccggtgcacctgttccagggtgacgaggacggcgtcgtgcccgtgcagctgcagcggcacatatgcaataagctcggctgggtcagctaccacgagctccccggagctgggcacttcttgtcagcggtgccaggactcggcgacaggatcctcagcacgctcctgtcctcgccggcgtcggcgtgactgatccacgactcgcacctagcaagtactagactactagtacatgactgatgttgctgtagctatgtctccaaagcattgctggtcgctgaagaaaagcactttatatgagcttagactatctctagcagatttattatcacatctcatatctcactctctatttcaaactcagaaaaaaaaaaaaaaa

SEQ ID NO: 96438 - protein, 383 aa, Zea mays
  misc_feature: Ceres CLONE 1674059
  misc_feature (132)..(374): Pfam Name: Abhydrolase_1 Pfam Description: alpha/beta hydrolase fold
MAAGAASTGNWSRATGAMRAAMVLWVCLAYMRGVCEDWSPLRLLVLLVAATLVARWFLNAVRPPPSTPCGTPGGPPVTAPRVRLRDGRYLAYAQSGVSRDRARFKVVYSHGFSGSRMDSPRASQELLEELGVYMVAFDRAGYGESDPDPRRSPESAALDIQDLADALGLGDKFHLVCSSLGSHAGWAAVRYIPHRLAGLAMMAPVINYRWRGLPRGLARQLYGRQPVGDQWSLRVAYYAPWLLHWWMSQPWLPTSTVVDGSAPFPNALDEKNRVMALSNCMFHSRARLATQQGVQESFYRDMTVMFGRWTDFEPTDLEKPPFPVHLFQGDEDGVVPVQLQRHICNKLGWVSYHELPGAGHFLSAVPGLGDRILSTLLSSPASA

SEQ ID NO: 96439 - DNA, 1081 bp, Zea mays
  misc_feature: Ceres CLONE 1674549
  misc_feature: Encodes the peptide sequence at SEQ ID NO. 96440
aacggcactagcagcgacacaataattaatcagggctcatcatctcgcaatctccatctaggtcaaccatgacgaacggcttcctgtttcgggagtacatcggcgcgcagttcaccggcgtccagttcagcgacgtgcccatcaactccaagctcgccttcaacttcatcctcgccttcgccatggactacacgccggtgaaccagcatcccacgccggcgcccaccaacggcgtgttcagcccgttctgggacacggggaacctgtccccggccgccgtggccgccatcaaggccgcgcacccgaacgtggccgtcatggcggggctcggcggcgacagcgtgcaggacatcgtcaaggccgtcttcaccccgacctccatcgactcgtgggtggccaacgccgtgacgtcgctcacgggcatcatcaacacgtacgggctcgacggcgtcgacgtcgattacgagcacttcgcccgcggcgctgacgtgaacaccttcgtcgagtgcatcggccgcctcctgacgcagctcaagaagaacatgccgtggatcaccacctccatcgcgccgttcgaggaccccgtggtccagaagtactaccagtcgctgtggcgcaagtactccggcgtcatcgactacgtcaacttccagttctacggctacggcgacaacaccgacgtcgccacgtacgtccagttctacgaccagcagtcggcgaactaccccggcggcaaggtcctcgccagcttcatgaccggcaacaccaccggcctgatctcgccggacctcggcatcagcgccgccaaggagctgcagcggcagaacaagctgccgggcctcttcatctggtcagccgacagctccaagaggagcagctttggcttcaagtacgagatcgaggggcagcagatcattgccaaccattgatctcggatccgaatatcgtatggggcctcgccacgctgtgatggatgaaatataaaatgaatttatcaaggaataggcacgctgctacgtgtactatttctatgaatgatgaataaataaagagattgcattgagcgaaaaaaaaaaaaaaa

SEQ ID NO: 96440 - protein, 286 aa, Zea mays
  misc_feature: Ceres CLONE 1674549
  misc_feature (9)..(266): Pfam Name: Glyco_hydro_18 Pfam Description: Glycosyl hydrolases family 18
  misc_feature: SWISSPROT Homolog: EC 3.2.1.14 Chitinase
MTNGFLFREYIGAQFTGVQFSDVPINSKLAFNFILAFAMDYTPVNQHPTPAPTNGVFSPFWDTGNLSPAAVAAIKAAHPNVAVMAGLGGDSVQDIVKAVFTPTSIDSWVANAVTSLTGIINTYGLDGVDVDYEHFARGADVNTFVECIGRLLTQLKKNMPWITTSIAPFEDPVVQKYYQSLWRKYSGVIDYVNFQFYGYGDNTDVATYVQFYDQQSANYPGGKVLASFMTGNTTGLISPDLGISAAKELQRQNKLPGLFIWSADSSKRSSFGFKYEIEGQQIIANH

SEQ ID NO: 96441 - DNA, 1189 bp, Zea mays
  misc_feature: Ceres CLONE 1674836
  misc_feature: Encodes the peptide sequence at SEQ ID NO. 96442
aatcatatttatatatatccaatccttcccacatcgcatccatccgctcagctcgatcgaacttcgcacacgcgtacattaattctcaggaacgtactggttggtggtggtagtagctactagctactataaactatggaccagatgctgggcaagcacctgcagatgccttccgtgactacgagcgccgcctgccagcagccgcagtcgccgccgccgtcgccgcagcagcagcagcagtaccggggcgtgcggaagcgcaagtggggcaagtgggtgtcggagatccggcagccgggcaccaagacgcgcatctggctcggcagcttcgagtcggccgagatggccgcggtggcgcacgacgtggcggcgctgcgcctgcggggccgcgacgcgcagctcaacttcccgggctgcgtcgcctggctaccccgcccggcgacctcgcacgcgcgcgacgtccgcgccgcggcggccgaggccgccgaccgcgtgcgctgcgacccggcgctgctgctgctccagcaggcggcggcggcgtcagcgcggtgccacgaccacaaccacgagttcggggccgggccggcgccggtggtcgagctcgggagcgacgaggagttcgagctggacctggactcgcccagcctctgggccgagatggccgaggccatgctcctggacccgccgggctgggccaccggcgtcgtcggcgacgcggcggaggtggccctgtgctggccacacggctccctctgggacgcctgctagctcggccaggcaccccggctctggctctgcctgcgagtgtttggccatggccgatgtggccaccggacgctgtttggtctcacaagtgtcgcagtgcttttggtgtgtgccactgtgagcgcgtctctgttgattctcccccgcgtgtggttttgctttacgtctgctgctgttgggcttgctgttttcgttcctgttatcatcttaccagtatcactaccattagctaggcaaaatgataacagtccagatcatctgaagacaaacaaaattagtacggctgtgccctgctgatactgatattatggtttggtctattcctgcattttgtactaatttgtgcagtcacattattcgagatgaccgtgcatgcaagtaccccacagaaaatgatcttgtattgtaaaaaaaaaaaaaaaaa

SEQ ID NO: 96442 - protein, 210 aa, Zea mays
  misc_feature: Ceres CLONE 1674836
  misc_feature (34)..(85): Pfam Name: AP2 Pfam Description: AP2 domain
MDQMLGKHLQMPSVTTSAACQQPQSPPPSPQQQQQYRGVRKRKWGKWVSEIRQPGTKTRIWLGSFESAEMAAVAHDVAALRLRGRDAQLNFPGCVAWLPRPATSHARDVRAAAAEAADRVRCDPALLLLQQAAAASARCHDHNHEFGAGPAPVVELGSDEEFELDLDSPSLWAEMAEAMLLDPPGWATGVVGDAAEVALCWPHGSLWDAC

SEQ ID NO: 96443 - DNA, 1299 bp, Zea mays
  misc_feature: Ceres CLONE 1674848
  misc_feature: Encodes the peptide sequence at SEQ ID NO. 96444
aaacgttcgacgcagtgtctcttctattaacctgcgagcacgcgtggcgccggcgaggccacacgcagcccaccagtaagccgccaccgccatgcggctcccctccggcgcacgcctcgcgctcctgctcgtccgccgctccctctcctccgcgtcctccgccgccgccgcccccgcatcccgcctctcgcgcgcgcacagaggtgagccccgacagaccccaccccactaggtccccgattctcccggttcctcgggcgggcctcgcctggtcgccccgtgttcctcgggcgcgcaagcgatgatgctgaggccgcccgcgttagcgtgctgcaaactctacatctccgaggcccgcaactcgggggcgttgcgtgccatcgagcacgcggcggcggcgctccgcccgttggccgtgctcgtcaacaccttcgccgacgacgcctacaaccgggtcgggtacacgctcgtgtcccccctcgcgggcggcgccgcctcgccgccgctgcgctgcgcggcgttccgcgtggtcgcggccgcgatcgaggccgtcgacctggacgcccacgccggcgcgcacccgcgcctcggcgtcgtcgaccacatcgccttccaccctctggccagcgcccgcctcgaggacgtcaccgcgctcgccagggccgtggcggcggacatcggagacaggcttcaagtgccgacgtacctgtacggcgcagctcacagagacggcaggacgctggcgtccatcaggaggcagctgggctacttcacgccgacctcccccggcggcgagcagtggcacggcgcgccggactcgctgctgccggtggccccggacgccgggccccggacgtcgtccgcgtccaatggcgtggtggtggtgggcgccacgccgtgggtggacaactacaacgtgcccctggccacgaccgacgtcagcgtcgcgaggcgcatcgcgcgcgcggtcagcgagcgcggcggcgggctcgcgtgcgtgcaggccatggggctcgcgcacggcgacggcgccaccgaggtcgcctgcaacctacttcacccggacgcggtgggcgccgaccaggtgcaggagagggtgagccggctcgccgccggcctcggggtcggcgtcggccaggggtacttcaccgacttctcgcgggagaaggtcgtcgagctgtacttgcaggccgctcaagctgcctgaggcttctcggcagtgatagattgtttattgttcagaaagcagggtaatggaataatctactactgtatctaggacaaaaaaaaaaaaaaaaa

SEQ ID NO: 96444 - protein, 301 aa, Zea mays
  misc_feature: Ceres CLONE 1674848
  misc_feature (7)..(199): Pfam Name: FTCD_N Pfam Description: Formiminotransferase domain, N-terminal subdomain
MMLRPPALACCKLYISEARNSGALRAIEHAAAALRPLAVLVNTFADDAYNRVGYTLVSPLAGGAASPPLRCAAFRVVAAAIEAVDLDAHAGAHPRLGVVDHIAFHPLASARLEDVTALARAVAADIGDRLQVPTYLYGAAHRDGRTLASIRRQLGYFTPTSPGGEQWHGAPDSLLPVAPDAGPRTSSASNGVVVVGATPWVDNYNVPLATTDVSVARRIARAVSERGGGLACVQAMGLAHGDGATEVACNLLHPDAVGADQVQERVSRLAAGLGVGVGQGYFTDFSREKVVELYLQAAQAA

SEQ ID NO: 96445 - DNA, 1560 bp, Zea mays
  misc_feature: Ceres CLONE 1674981
  misc_feature: Encodes the peptide sequence at SEQ ID NO. 96446
aatcggagggtctctccattccatccgaatctagctgctgctgctggttagctcaatcgatcaatcaatggcggcagcaacggcaactgcaacggaggctgccggccaccaccaggagcagcagcagcgtttccgcgtcgtcgacacggccctggtggcgcctgcagctggtcccgcactgccgccgcgctccatcccgctcaccttcttcgacgtcaagtggctgcacctcccgcccgtggagcgcgtcctcttgtaccgcctctccccggacgccgacgtccccgccattctctccggtctcaggacctccctctcccaggccctccgcgccttctacccgatggccggccacgtccgcatgccggccaccaataaccgccgccacgagctgtgctaccgccccggcgacgccgtccccttcaccaccgcggagtacgacgtggacatcgaccacctcatcgccgacgactccgtccccgtgcaggtggcccagctcgcccctctcgcgccgcacctgcccaagggccgcgccgtgctcgccgtgcaggccacgctgctgctcggccgccggggcctcgcggtcggcgtcaccgtccaccacaccacctgcgacggcgcagggtccacgcacttcctccacacatgggccgccgccgcagccgcaagagcagacatcatccccccgccccccgtcatcgaccgggaactcatcccggaccccaggggcctgtacgacgtgtacctcagaagcatgccgcccatggtgtcccaggacgactttgagttcgtgctgggcaagcctcaggatcccggcgaggacaaggccctggccacgttcacgctgtcccagcagcttctgcagagcatcaagagcgcggtcgcccacgaggcggcgcggcgtggcatggtgacgccgccccggtgctcgtcgatcctcgccacctacggcttcatctggtcctgctactgccgagcccgaggggcggcggcagagaggagctacttcctcttctccgtggaccagcgctctcgcctgaagccggccgccgtcccggagaagtacctgggcaactgctgttgcccggccatcgcgagggcgcgggcggacgaggtgtccgccgggggcatcgcggggctgttcgcggcgtgcgcggcggtggcggcggcgttggaggaggaggtgcgcgagggggcgcaggagcggtgggacacgtgcgtggcgcgggtgaaggaggccacggccaaggggatgttgtccgtggccggatcgcccaggttccgcgtctacgacctcgactttggattcggccggccggagaaggtggacatggtgtcggtggccaagaccggcgccatctccgtggcggacgcgcgtgttggaggtggaggcgtggaggtgggtatctctctgccggtggcgtcgggtgacatggaccgcttccgacagagcgttgcagacgggatggagtggctccggttgctgtgattgcatcatttgcatgatgtgtgcgtgttaataatgttgatttctacaacaaagaaaaaaaaaaaaaaaaa

SEQ ID NO: 96446 - protein, 473 aa, Zea mays
  misc_feature: Ceres CLONE 1674981
  misc_feature (20)..(467): Pfam Name: Transferase Pfam Description: Transferase family
  misc_feature: SWISSPROT Homolog: EC 2.3.1.153 Anthocyanin 5-aromatic acyltransferase
MAAATATATEAAGHHQEQQQRFRVVDTALVAPAAGPALPPRSIPLTFFDVKWLHLPPVERVLLYRLSPDADVPAILSGLRTSLSQALRAFYPMAGHVRMPATNNRRHELCYRPGDAVPFTTAEYDVDIDHLIADDSVPVQVAQLAPLAPHLPKGRAVLAVQATLLLGRRGLAVGVTVHHTTCDGAGSTHFLHTWAAAAAARADIIPPPPVIDRELIPDPRGLYDVYLRSMPPMVSQDDFEFVLGKPQDPGEDKALATFTLSQQLLQSIKSAVAHEAARRGMVTPPRCSSILATYGFIWSCYCRARGAAAERSYFLFSVDQRSRLKPAAVPEKYLGNCCCPAIARARADEVSAGGIAGLFAACAAVAAALEEEVREGAQERWDTCVARVKEATAKGMLSVAGSPRFRVYDLDFGFGRPEKVDMVSVAKTGAISVADARVGGGGVEVGISLPVASGDMDRFRQSVADGMEWLRLL

SEQ ID NO: 96447 - DNA, 1598 bp, Zea mays
  misc_feature: Ceres CLONE 1675067
  misc_feature: Encodes the peptide sequence at SEQ ID NO. 96448
agagctacccccgctcgcctttagctagctacccaccatggccctcccgccgtcctcctcgccgtcgtcgctctccgccgcgtcagcgcagcccacgcccctgcacctgcacctcccgaccaaggcgcccggccgcctcccgctgctccccttctcgcgcgccgccctcccgccgccgctgcgcctccgcattgcgcgcaccagcctccccccgggcacgcccctcccgcgcgcgctcctgccaccaccctccgcctccgccgacgccgcagcctccgacgtcggcggcggcggcggcttcggcggccatgacgacgacgacagccacaaccaccacggcggcgacggcggcgagggtggcggcgacgacggcggccacggcgacgacgcgcccggcggcggcgacgcccgcggggaggcgctgttcgtgctggcgcagctgggccgcaagctcgacagcctgccgtccgatctcgccgccgccgtcgacagcggccgcatcggggccgacatcgtgcgccgcttcaccgaactcgaggccaacggcttcttccgatggctcctccagttccagggcttcagggagaggctcctcgccgacgagctcttcctcaccaagctcggcatagagtgcggcatcggtctcgtcgccaagaccgtggctgagttccagaagaggggggacaatttcttcaaagagattgaagttgtcatatctgatgtggtcatggcgattgttgcggacgtcatgcttgtctatcttcctgctccaactattggtttacagccgccactggcaagaaacgctggagctattgccaactttttctataactgccctgataatactttccaaattgctatggctggaaggtcattctcacttctgcagaggattggagcttttgtgaggaatggtataaagcttttggcagtgggaactactgcttctttgattggcactagtgtcacgaatgcagcgctcaaagcaaagagggctgttgataaggaccttgaggacgaagtcatggaaattccagtcgtctcaactagtgttgcctatggtgtatacatgtccatttctagtaacctcaggtatcagcttctggctggtgtgatcgagcagaggatgctggagccgttgctgcataaccagaagctactgctgagtgcaatgtgcttcatcgttcgtacgggcaacacattccttggctccttgctgtgggttgattatgccagatggataggcgtccagaagtctcacgaagaggcctaaagttctagcagcttgcctgcatgttccgctgtcactgcctcactaggcacgttcacaataccatcgatggcttgcctgcctctatagaatgctgatctactcttcactggaggcccccttatatataggacaaaaatcccaattttgtttggaaaaccacaagtagggatatatctgtcgaattctcgtatgcaacggcaacgccgttctacccctcaacttttttttttcctttttctactttgcaacatgcaacaagggctgtcattgatcgaaattcaaatatatgttacattgggaattccaaaaaaaaaaaaaaaaa

SEQ ID NO: 96448 - protein, 412 aa, Zea mays
  misc_feature: Ceres CLONE 1675067
MALPPSSSPSSLSAASAQPTPLHLHLPTKAPGRLPLLPFSRAALPPPLRLRIARTSLPPGTPLPRALLPPPSASADAAASDVGGGGGFGGHDDDDSHNHHGGDGGEGGGDDGGHGDDAPGGGDARGEALFVLAQLGRKLDSLPSDLAAAVDSGRIGADIVRRFTELEANGFFRWLLQFQGFRERLLADELFLTKLGIECGIGLVAKTVAEFQKRGDNFFKEIEVVISDVVMAIVADVMLVYLPAPTIGLQPPLARNAGAIANFFYNCPDNTFQIAMAGRSFSLLQRIGAFVRNGIKLLAVGTTASLIGTSVTNAALKAKRAVDKDLEDEVMEIPVVSTSVAYGVYMSISSNLRYQLLAGVIEQRMLEPLLHNQKLLLSAMCFIVRTGNTFLGSLLWVDYARWIGVQKSHEEA

SEQ ID NO: 96449 - DNA, 968 bp, Zea mays
  misc_feature: Ceres CLONE 1675086
  misc_feature: Encodes the peptide sequence at SEQ ID NO. 96450
actccagctccacttcttccccgcacaccacagtcacacgcgcagtgctagacgacgaacaccagagggcaggcagatgatgatggcgtccgttctcgccgtctcccggtggtcgtcgctgcttctccccctcctcctcctccacctcctcctcctggtggcgacggcgtcgcaggccctcaacgtcggcgacctgctcgggacagcagcgccttcggggagccagggctgtagccggacgtgcgagtcgtcgttctgcatagtcccgccgctgctgaggtacggcaagtactgcgggatcctgtacagcggctgcccaggcgagaagccctgcgacgcgctcgacgcctgctgcatggtccacgaccactgcgtcgacacccacaacaatgactacctgaacacgcggtgcaacgagaacctgctgagctgcctcgacggggtgagcccggcggggccgacgttcccggggaacgagtgcgacgtcggccagacggcgtccgtcatacgtggggtcatcgagtcggcggtgctcgcgggcaagatccttcacaagcgcgacgacggccagtagccggcgtcctggcagtggcaggacaggagcgggccgacctgagtcagtgaggctagctcgcggttggtacagacagtataaagccgcttgtgctggatttcaaggttatgaacggccggaccacctgttggagttcgtttacgtattcggtttagttccttcactctaaaataaaatttagaataaatgtcaaaccttcgtcatgaatctgaattcgtcttctgcaacaaatttaaaactcaatccattaaactcaagtcagattttgtttttttaatctttttatgtgtggttatcctgaatataatctccctatataatagagttccctttaaatgtcaatgagaaacaatcaatctactgtaggttgaggtttgaaaaaaaaaaaaaaaaa

SEQ ID NO: 96450 - protein, 165 aa, Zea mays
  misc_feature: Ceres CLONE 1675086
  misc_feature: SWISSPROT Homolog: EC 3.1.1.4 Phospholipase A(2)
MMMASVLAVSRWSSLLLPLLLLHLLLLVATASQALNVGDLLGTAAPSGSQGCSRTCESSFCIVPPLLRYGKYCGILYSGCPGEKPCDALDACCMVHDHCVDTHNNDYLNTRCNENLLSCLDGVSPAGPTFPGNECDVGQTASVIRGVIESAVLAGKILHKRDDGQ

SEQ ID NO: 96451 - DNA, 1856 bp, Zea mays
  misc_feature: Ceres CLONE 1675263
  misc_feature: Encodes the peptide sequence at SEQ ID NO. 96452
actcctcacctcgattgatcgcatattcacatcccaaacccccggcctctccgctacgcgacaccgcgctcgccgcctcgaggaatctcatcccatcccgttcccaccaaaccgatccgatcgaatagtccgcgagcgacgcccatggaggcggcggcggagctggcgctgcgcctccgggcggccgccaacgaccgcctcgctcactacgagccgctggcgctcgtcgccgcgccgctcctggcgctcctcgtcgcgcggaccctccacgccacggccagcgccgtcgccgaccgggggctcatcgccatcgccatcgccgccgtcaagttgctgccgggagtctccggctacatcgcggcggagaagaagaaggttgttgacaagatgcaatcaggtggggccaagaacaatcggcgagctgagttgccaactattggccttgccgagcaagtgatagaggaacttgaaacactgaaagccaaagatgtagactggcagggaaaatgctctggcacagtatatattgctggaagtgagtctgagggtcattttcaattgataaacaaggcgtactctatgttttcacacaccaatccgctccatcaagatgtatttaagagcgtagcaaacatggaagctgaagtcgttgcaatgacagcggctttacttggcagcaaagaaaaatcatctggtggacaaatttgcggcaacatgacatcaggtggaactgaaagcatattattagcagtcaaaacatcacgtgactatatgcgatcaaagaaaggaattacaaggcctgaaatgataattgctgaatcagcacattctgcatatgacaaagctgctcaatacttcaatattaaagtgcggcgtgtacctgtgaacaaagagtttcttgcagatgtgaaaggattcaaacgatgcataaatggaaacaccataatgatggttggatctgcaccaggatttccgcatggtttaattgatcctattgaggaacttggggaactggcttcgcgctatgacatttgcttgcatgttgatttatgccttggtggctttgtgctgccttttgctcataagcttgggtaccctattcctccctttgatttttctgtcaagggtgttacatccatctcatctgatgttcataagtacggattagcaccaaaaggcacaagcattgtcctgtacagaaatcatgaaattagaaagcatcagtttgttgctgttactgagtggaccggtggcctttacgtttctcccacaattgctggaagcaggccaggtggattgatagcgggagcttgggctgctatgatgtctctcggactgaacggctacttggacagtacaagccgtatcatggatgtttcgaagaaaatacaaagagggattggagagatcccagggttgtttgtgatagggaaaccggatatgaccgttgtggcgttcggctcagacgttgtcgacatatttgaggtgaacgacataatgtcatcaaaaggttggcatctcaatgctctgcagagacctaacagcttgcatatttgtgtgacccttcaacacacgactgtttacgaccaattcctgaaggatctgcaagactctgtgaacactgtgaaagcaaacccaggcccgattagcggcggaaaggctcctatctacggcgccgcagggaagatgccggacagaggcacggtgagggagctgctcgtggagttcatggacagctcttgctgaatttattatggcttttgagaagaatttgttcttgtacatgaaacttctatttcttttcaactgaaaaggcagagctcctaccatttgtttcagaaaaaaaaaaaaaaaaa

SEQ ID NO: 96452 - protein, 533 aa, Zea mays
  misc_feature: Ceres CLONE 1675263
  misc_feature (89)..(441): Pfam Name: Pyridoxal_deC Pfam Description: Pyridoxal-dependent decarboxylase conserved domain
  misc_feature: SWISSPROT Homolog: EC 4.1.2.27 Sphinganine-1-phosphate aldolase
MEAAAELALRLRAAANDRLAHYEPLALVAAPLLALLVARTLHATASAVADRGLIAIAIAAVKLLPGVSGYIAAEKKKVVDKMQSGGAKNNRRAELPTIGLAEQVIEELETLKAKDVDWQGKCSGTVYIAGSESEGHFQLINKAYSMFSHTNPLHQDVFKSVANMEAEVVAMTAALLGSKEKSSGGQICGNMTSGGTESILLAVKTSRDYMRSKKGITRPEMIIAESAHSAYDKAAQYFNIKVRRVPVNKEFLADVKGFKRCINGNTIMMVGSAPGFPHGLIDPIEELGELASRYDICLHVDLCLGGFVLPFAHKLGYPIPPFDFSVKGVTSISSDVHKYGLAPKGTSIVLYRNHEIRKHQFVAVTEWTGGLYVSPTIAGSRPGGLIAGAWAAMMSLGLNGYLDSTSRIMDVSKKIQRGIGEIPGLFVIGKPDMTVVAFGSDVVDIFEVNDIMSSKGWHLNALQRPNSLHICVTLQHTTVYDQFLKDLQDSVNTVKANPGPISGGKAPIYGAAGKMPDRGTVRELLVEFMDSSC

SEQ ID NO: 96453 - DNA, 1194 bp, Zea mays
  misc_feature: Ceres CLONE 1675392
  misc_feature: Encodes the peptide sequence at SEQ ID NO. 96454
aatcacgccacgctctcagtcacgccacacacccaccactctcctacttgtccgcctctccgtcgtctccctctccgcgcccccgctccaggtcaactctgccatccacgggagatcggtcgaccgaccggcctatcatccatggcgctcgacgcggccctcgacgtgtgcagcaagacgccgtcgccgtcgccgccgacggtcgactcgtcggcgcgcggcgggaggcggtccaagcgccgcgccgggagccccgccagcgacggcggcggaggagtcgacggcaacgaacagcccgagcaggaggagtacctcgcgcagtgcctcctgatgctctcgcacggcctccccggcgacggggccgcgccgccttcggcggcggcgaaggcgaaggcgatccagcagcagcatcagcacggccggtacgagtgctccgtgtgcggcaaggtgtacacgtcgtaccaggcgctgggagggcacaagacgagccaccggaagccgccggtggtggcgcccgcgcccgcgccagcaccaggaggcgaggccgaggcgtcgttgtccggcggcaccgcgcacgcggcgacggagaagacgcaccggtgctcggtctgcaagcgcacgttccagtcgggccaggctctgggcgggcacaagcggctgcactacgaggccaaggccaaggacgcggacgctgtggcggcgacggccgtgctgcaaaacttcgacctcaacctgccggccgagggcgcgccgccggaccccaagcgggcgcggacgatgctgctgctggcttgatccatccccgccggtcgatccaacggcggcgggctggagttggcgccaagtggccgtctaggttttttcatagagttgtttggtaggtcgtccaattccgatggttatttggttggtttctttgttaattttcggtttgcgtcgcgtgccgtcggctgcgtcggtctcggttcgttcggtgctgattgttatgatgcacctttttttcggttcagacttcctaggaagatgattcatttctccatattctgcgacgacgcggagccgccggattaagaaccggacggctgatgcacgcggtctctcgctatttatatatagcacctgtaaatcctggtgttcaaagttcaaacaccccacatacacatgcatggaaagttgtaaaaaaaaaaaaaaaaa

SEQ ID NO: 96454 - protein, 217 aa, Zea mays
  misc_feature: Ceres CLONE 1675392
MALDAALDVCSKTPSPSPPTVDSSARGGRRSKRRAGSPASDGGGGVDGNEQPEQEEYLAQCLLMLSHGLPGDGAAPPSAAAKAKAIQQQHQHGRYECSVCGKVYTSYQALGGHKTSHRKPPVVAPAPAPAPGGEAEASLSGGTAHAATEKTHRCSVCKRTFQSGQALGGHKRLHYEAKAKDADAVAATAVLQNFDLNLPAEGAPPDPKRARTMLLLA

SEQ ID NO: 96455 - DNA, 1447 bp, Zea mays
  misc_feature: Ceres CLONE 1675523
  misc_feature: Encodes the peptide sequence at SEQ ID NO. 96456
agcgcgcgagctcctcccctgtacccctacctctccaccccctcctcgtgccgtccacgcaccaccggcgcgccgcgctgccatggccatgaggccacgcgccgcgctcgccctctccctggcagccggcgtcccgctggtcctcctcctcctcctcctcgcgcccggcgcgcgcgccgacgacggcagcggcgggtgcggggcggcgggcggcggcgaggcggcgccgggcgaccgcgcgcgggccagggcgctgaagatcgcggccttcttctccatcctcgtgtgcggggcgctgggctgctgcctgcccgtgctggggcggcgcgtgccggcgctgcgccccgacagggacgtgttcttcctcatcaaggcgttcgcggcgggggtcatcctggccacggggttcatccacatcctccccgacgcgttcgagaagctcacgtccgattgcctctccggcgggccgtggcaggacttccccttcgcggggctcggcgccatggtcggcgccatcggcacgctcgtcgtcgacaccgtcgccacgggctacttcacgcgcgtccacttcaaggacagcgccgccgccgccgtgggcgccgccgccgtcggcgacgaggagaagcagcagcagcaggcggcgtcggcgccgcacgtcgacgacggagcagacggcgacggccacggccacggcgggcacgtgcacatgcacacgcacgcgacgcacgggcactcgcacggcgcctcggcgctcgtggccgccgtcggcggcgccgagggcgacaaggagcacgcgctgcgccaccgtgtcatcgctcaggttcttgagcttgggattgtggtgcactcggtgatcatcggcatctccctcggcgcgtctcaagaccccagcaccatcaagcctcttgtggtcgccctcagcttccaccaaatgttcgagggcatgggtctaggcggctgcatcgttcaggccaagttcaagctgcggtcgatcgtgacgatggtgctcttcttctgcctgactacgccggtgggcatcgtggtgggcgtcgggatctcgtcggtgtacgacgaggacagccccacggcgctggtcgtggagggcgtgctcaactcggtggcggcggggatcctggtgtacatggcgctggtggacctgctcgccgaggacttcatgaaccccagggtacagagccggggcaagctgcagctcggcatcaacgcctccatgctcgtcggcgccggcctcatgtccatgctggccaagtgggcctagtttactagccacttttttgctctgtgccctctcgattccagtttttttagttgagttgctgtaaaaatactactgttatggagaaacgaacgaatacaacaactcttttttctgaaaaaaaaaaaaaaaaaaaaaaaaaaaaaaaaaaaaaaagaaaaaaaaaaaaaaaaa

SEQ ID NO: 96456 - protein, 397 aa, Zea mays
  misc_feature: Ceres CLONE 1675523
  misc_feature (56)..(394): Pfam Name: Zip Pfam Description: ZIP Zinc transporter
MAMRPRAALALSLAAGVPLVLLLLLLAPGARADDGSGGCGAAGGGEAAPGDRARARALKIAAFFSILVCGALGCCLPVLGRRVPALRPDRDVFFLIKAFAAGVILATGFIHILPDAFEKLTSDCLSGGPWQDFPFAGLGAMVGAIGTLVVDTVATGYFTRVHFKDSAAAAVGAAAVGDEEKQQQQAASAPHVDDGADGDGHGHGGHVHMHTHATHGHSHGASALVAAVGGAEGDKEHALRHRVIAQVLELGIVVHSVIIGISLGASQDPSTIKPLVVALSFHQMFEGMGLGGCIVQAKFKLRSIVTMVLFFCLTTPVGIVVGVGISSVYDEDSPTALVVEGVLNSVAAGILVYMALVDLLAEDFMNPRVQSRGKLQLGINASMLVGAGLMSMLAKWA

SEQ ID NO: 96457 - DNA, 983 bp, Zea mays
  misc_feature: Ceres CLONE 1675650
  misc_feature: Encodes the peptide sequence at SEQ ID NO. 96458
agcaacagatacacacacactcgggtaaagctatctcgagctagctagctgctgtaagccgttgccatggccaaaatggtgttgctctgcgtgctcgtctccttcctcctgatgcccttggcctccctagccctgacgcaggacttctgcgtcgccgacctgacctgcagcgacttctacttccacggcctggccggccagggcaaaataaacccactcatcaaggccgccgtgaccccggccttcgtgggccagttcccgggcgtcaacgggcttggcatctctgcggccaggctcgacatcgaggtgggcggcgtcgtgccgctgcacacccacccggcgggctcagagctcctcttcgtgacccagggcaccgtcgccgccggcttcatcagctccggctccaacaccgtctacaccaagacgctgtacgccggcgacatcatggtgttcccccagggcctgctccactaccagtacaacgccggcaccggcgctgccgtgggcctcgtcgccttcagcagccccaaccccggcctgcagatcaccgactttgcgctctttgccaacaacctcccgtccgccgtcgtggagaaggtcaccttcttggacgacgcgcaggtgaagaagctcaagagtgtgctcggcggcagcggttaacttgtttttcgagacaatacagtgcaggctgggtatgcatcgtcgccgtcgtcgtcttggtccgtcgtcatcgaatggaacgcgtgtgcttgctgctgcatgcgtgcgtgcacctgtcgtcgcgtgtcaaagtactcgtggtctatttcatcttacccttatttattcatctacttttcattcagggatgtattcagtttccatattgcattttgttgcaatgaaagagtaacatgtgcatctgattggttcaaaatagctttgtggtcgatgtcgtttgtaaagctatatatgatcgcttaaggtcaaaaaaaaaaaaaaaa

SEQ ID NO: 96458 - protein, 197 aa, Zea mays
  misc_feature: Ceres CLONE 1675650
  misc_feature (40)..(187): Pfam Name: Cupin_1 Pfam Description: Cupin
  misc_feature: SWISSPROT Homolog: EC 1.2.3.4 Oxalate oxidase
MAKMVLLCVLVSFLLMPLASLALTQDFCVADLTCSDFYFHGLAGQGKINPLIKAAVTPAFVGQFPGVNGLGISAARLDIEVGGVVPLHTHPAGSELLFVTQGTVAAGFISSGSNTVYTKTLYAGDIMVFPQGLLHYQYNAGTGAAVGLVAFSSPNPGLQITDFALFANNLPSAVVEKVTFLDDAQVKKLKSVLGGSG

SEQ ID NO: 96459 - DNA, 970 bp, Zea mays
  misc_feature: Ceres CLONE 1675661
  misc_feature: Encodes the peptide sequence at SEQ ID NO. 96460
aatcgatcgccacacttgagagcttgccgtccagcgttcatcggatagctcccctgagctcgatcggatcgtgcacagcccgaacagccgctccaccctcccgctcagctcgctcttcggcggtgctgctctcgatcgtctttctccgtcaccggcggtcgcttagcctccgggatcccggccggtcgtcttcttcgccgcattatctctctttctctctctaacacaaggacgatgtcgagccggaggtcccgcgcgtcgacggtctcggaggaggagatcaacgagcttatctcgaggctgcagacgctgctccccagcgcgcgccgccgtggcggcagccaggcgtcgacgacgaagctgctcaaggagacctgcagctacatcaagagcctgcaccgggaggtggacgatctgagcgaccgcctgtcggacctcatggccagcatggaccacaacagccccggcgccgagatcatccgcagcctcctccgctagcccaagtccgtccgtccggccatggcgtgacggccggcctctcgccatcgccagatctcagcgcattgccgagtgtgtgtgtgtgtaccacatatagcagctgaatatacccaaggacgacgtacgccgacgacaggctaaggctggtttattaattggtagggcattattaagtactactccgtattaactagggctgcctagcttaagtatggtttctctctcttccactcttggctgtttgtttccttgctatactctcctagtagcttagctccttttccatttgtttgtacttggctgcttcgtcccatgttcgtcgtcgtcgtcgtggtggtggtgtaaacctatgtgtgtggtctggatcgagttgtttcctccttgacagacaaccgaccaaccccgatcgatctgtcaacttgtactacgtacgtactggtaatatatcaatatctaaaaaaaaaaaaaaaaa

SEQ ID NO: 96460 - protein, 87 aa, Zea mays
  misc_feature: Ceres CLONE 1675661
  misc_feature: Functional homolog of the protein sequence given in SEQ ID NO 96889
  misc_feature: Useful for making plants with modulated seedling growth
MSSRRSRASTVSEEEINELISRLQTLLPSARRRGGSQASTTKLLKETCSYIKSLHREVDDLSDRLSDLMASMDHNSPGAEIIRSLLR

SEQ ID NO: 96461 - DNA, 1821 bp, Zea mays
  misc_feature: Ceres CLONE 1675748
  misc_feature: Encodes the peptide sequence at SEQ ID NO. 96462
actagctctcccgatcctctcctgcctgtatcgcatagtcacaggctcacagcacaacgcctgccaaacctgcagccaccgatcgagctacgagccacctagtccggtagtccctgcagtagccatgtccaaggccttcgccaagtcgctgtcccagctgaacaaggccctggtgaggaggctcaaggccctcgtcgtcgtcacccgcgcgcagccgcctgcgccggcgaggccgacgacgtggtcggacgcgctgccgtcgccgtcgggcggcggcggcggcgtcgccgtgtgcaaggtggagggcggcctgctccggtcctcctccgccttcccgtacttcatgctggtggccctggagggcggcgggctcgccagggcgctgctgctcctgctgctctaccccgccctgcgcctgctcggccacgacaccgcggtcagggccatggccgccgtcaccttcctcgggctccgcaaggacgccgccgcgttccgggcgggcagggcctcgctgccccggctgctgctggaggacgtgagcgccgaggtgttcgacgcggccgtggcgccgccccgccgccggtgcgtctgcgtcagcgccatgccgagggccatggtgcagccgttcctggccgagtacctcggcgtcgacgccgtcgtggcgcccgaggtgagggagttcggagggtactacctgggcgtcatggaggacgagagcgaggtgctgcgtcggctggacgtggacaaggtgatcgccggagacaaaaaaggtggtggctgtggcgtctttggcgttgctggactcggctcctcgttcgaccagctcttccaaaatcattgcaaggaggtatacgcgccgaccgagtcggcgcggcggcgatggcacgcgctcccgcggcggcgctaccctcggccgctcatcttccacgacggccggatcgccttccggccgacgcccggcgcgacgctggccatgttcatgtgggtgccgctgggcgtggcgctcgccgtggcccgcgtcgccaccttcctggccctcccgttctcgctctccgtgcccctgctcgccgccctcggcatgcacagccgcgtcatcgccaaccccgcctcggcgtccaagagcctcttcgcctgcaaccaccggtccctgctggacccgctctacgtggccgcggccgcggggcgcaaggacctcgcggccgccacgtacagcatcagccgcctctcggaggccctgtcgccgatccccacgttccgcctcacccgggaccgcgcggcggaccgcgccgccatgcacgcgaggctgcggtcgtgcggcggtctggtcgtctgccccgagggcaccacctgccgcgagccgtacctgctgcggttcagcccgctgttcgccgagctcgggcacgacgtggcgcccgtggcgctgcactcgtcggtcggcatgttccacggcaccacggcggccgggtggaaggcgctggacccactgttcctactcatgaaccccacgccggcgtacatcgtgcatttcttggacaccgtcgacgtcgagtgcggcggcccggaggcggcgcgcgccgtggcgaacgagctgcagcggcgcatcgcggaggcgctcgggtacacgtgcacggggctcacgaggaaggacaagtacctcatgctcgccggcaacgaaggaatcgtcgacgtcagccacggcggcggtggcgccaagaagagaactacttgtgctacctagctagttctgaattttcattgcaggctttcacccgcttcagtgaatgaaggataacagttctataggtaaaaaaaaaaaaaaaa

SEQ ID NO: 96462 - protein, 537 aa, Zea mays
  misc_feature: Ceres CLONE 1675748
  misc_feature (318)..(434): Pfam Name: Acyltransferase Pfam Description: Acyltransferase
  misc_feature: SWISSPROT Homolog: EC 2.3.1.15 Glycerol-3-phosphate O-acyltransferase
MSKAFAKSLSQLNKALVRRLKALVVVTRAQPPAPARPTTWSDALPSPSGGGGGVAVCKVEGGLLRSSSAFPYFMLVALEGGGLARALLLLLLYPALRLLGHDTAVRAMAAVTFLGLRKDAAAFRAGRASLPRLLLEDVSAEVFDAAVAPPRRRCVCVSAMPRAMVQPFLAEYLGVDAVVAPEVREFGGYYLGVMEDESEVLRRLDVDKVIAGDKKGGGCGVFGVAGLGSSFDQLFQNHCKEVYAPTESARRRWHALPRRRYPRPLIFHDGRIAFRPTPGATLAMFMWVPLGVALAVARVATFLALPFSLSVPLLAALGMHSRVIANPASASKSLFACNHRSLLDPLYVAAAAGRKDLAAATYSISRLSEALSPIPTFRLTRDRAADRAAMHARLRSCGGLVVCPEGTTCREPYLLRFSPLFAELGHDVAPVALHSSVGMFHGTTAAGWKALDPLFLLMNPTPAYIVHFLDTVDVECGGPEAARAVANELQRRIAEALGYTCTGLTRKDKYLMLAGNEGIVDVSHGGGGAKKRTTCAT

SEQ ID NO: 96463 - DNA, 1728 bp, Zea mays
  misc_feature: Ceres CLONE 1675810
  misc_feature: Encodes the peptide sequence at SEQ ID NO. 96464
aaaccggccagccctggagctgcttctcggctcttccaacatcccctgcttgctaccgttcagttcagtcttcagttatccgagtgaccgtggatcagccatgcctgcgcttctagtgaacaccgtctcggtctcccccgccgcctcaaggctaggctcctcgcggcccgccacggcacggcgagcagcaagcgctcgccacggccacaggtgccgagccgaagcatccggcagctcgtgggtgtcggactacgacctgtacgagctgctgggcgtggagcggtcctcgccgcagtcggagatcaaggcggcgtaccggtcgctgcagaagcggtgccacccggacgtggccggcgccgccggcggccacgacatggccgtcgtcctcaacgaggtgtacgcgctgctctccgacccggacgcgcgcctggcctacgaccaggagcaggcgcgccgctccgagttcgccggctacacgggccgcccgctctactcctcctgggtcggcgccgagtccgagcgccgggcggtgttcgtcgacgaggtgcgctgcgtcggctgcctcaagtgcgcgctccacgcgtcccggaccttcgccgtcgagtccgtctacggccgcgcccgcgccgtcgcgcagtgggccgacgacgaggacaggatcgtcgacgccatcaacacctgccccgtcgactgcatctcgatggtggagaggtcggacctggcggctctcgagttcttgatgtccaagcaaccgcgcggcagagtccgcgtctccgaaggcaacgcggtgggagctcgcgcgcccaacatcttcaacgaagtcgccaagttcaagaaaaggttcgatgagatgaagcagaaatctgcggccagagaattccaggagtcggaggcggcacggcagtcgaggacttcagcagtccacgccatcagatccatgtcgaactggtggtactggcggccattcgggttcgggccatcggccccggtcaccattgtcctcgcttcgcgcctcctgccgccgccgccggcggcacccgctgaccccgtgacggagaggctccaagaagcagccgccgcccggcgcaagacgggaggcgcggccacggccacggcgcacgcagggcgcgaagactactggaccccgcagctgaacctgccgtcgtcagcttctccgccgagcattcaccagaggggaaggggcactcccgctcaccaaggccacggccgcaggcgaggagcagccggtgaagcggccgccgccgggaggaagggcataagcatcgacctgacggcgccgctgctattggggatcgtcgcggcggggttcgtgagttacaacggggagcaggtggccggaggtggcagcggcattcaggagcatgttggcggcgccatcgctcttggagtcgtcaacagctttgaaatgaagatcgttctggccggggtgacttggtccatcatcggcgcagccattgccggtgtgattcaggtactcggaagaagggaagaggacatttggaaatgaagatacttctcgaatccgtgtgtgtatatacacagaaaattgtgtacatatgtaatcctgcacaaatatgggtggctggctgttttatagaatcacttggggtagctcatgcgccggcctagaaaaggtagaaaaagccggaactccttgtcgccctacatcccaaaagaatttgcagaacataaaaaaaaaaaaaaaaa

SEQ ID NO: 96464 - protein, 475 aa, Zea mays
  misc_feature: Ceres CLONE 1675810
  misc_feature (52)..(113): Pfam Name: DnaJ Pfam Description: DnaJ domain
MPALLVNTVSVSPAASRLGSSRPATARRAASARHGHRCRAEASGSSWVSDYDLYELLGVERSSPQSEIKAAYRSLQKRCHPDVAGAAGGHDMAVVLNEVYALLSDPDARLAYDQEQARRSEFAGYTGRPLYSSWVGAESERRAVFVDEVRCVGCLKCALHASRTFAVESVYGRARAVAQWADDEDRIVDAINTCPVDCISMVERSDLAALEFLMSKQPRGRVRVSEGNAVGARAPNIFNEVAKFKKRFDEMKQKSAAREFQESEAARQSRTSAVHAIRSMSNWWYWRPFGFGPSAPVTIVLASRLLPPPPAAPADPVTERLQEAAAARRKTGGAATATAHAGREDYWTPQLNLPSSASPPSIHQRGRGTPAHQGHGRRRGAAGEAAAAGRKGISIDLTAPLLLGIVAAGFVSYNGEQVAGGGSGIQEHVGGAIALGVVNSFEMKIVLAGVTWSIIGAAIAGVIQVLGRREEDIWK

SEQ ID NO: 96465 - DNA, 1381 bp, Zea mays
  misc_feature: Ceres CLONE 1676175
  misc_feature: Encodes the peptide sequence at SEQ ID NO. 96466
aaaactcccctcaaagcccaaaccgcagttgccgcaaagtcccaaggcttttcccacgtccaaaggccatgttccgtcgatcctccccctccccctcctacagcgacgctctcatgcacaaccacgccgcgagcttctccgcgccgctgcccgtcaccgtcccgccccctcgcggcgccgcggccggcgggtacctcgacggtaatgtcggcgccttctcgtcgcctccgtcgtcgtactacaactacaacaacatccagaggagcgtcagctcgcactcgctcccgatgcgccttcagccgggcgacgtgtccctcggcggccgtggcttgtactcgccgtcttcgccgtccgcgcaccagctgacgccgacgctgccgccgctctcgtcttccccgtcctcctcctccggcgaactcttcgagttcacctcgccgtgccccgtccgccgcgtattcagcaccggcgatctccaggggatgaacgggtcgtcgccgccgcgcccggtgctgtcgggcgacggctgcggccacgagggtggcgggacgttctctcagaaggtcgtccggtacagcgccgtggagaggaaagagcggatcgagcgctaccgtgtgaaacggcaccagagaaacttcaacaagaagatcgcttacgcctgcagaaagacgctggcggacagccgtccgcgggtgaagggccgcttcgcgaggaacggcgaggccgacgccgatgccgacgagcgcgaggcgtccgaccacagctacgagtatggccgcagccacgacgagctgggcaacggcatcgcctacagcaccacggggagctgctacgatggcgacaacggcgagtggtggtggcgggcgcccggtgcctccgccgcgggcgacgacgatgctcagcggcagcggcaggtccgcttcgacgacgacgacgacgacgacgagctctgggcgaccctcggcgacatgatgtcgatgcacctggtctcgtaggctgcgatcgcctgcacgctgcaggctacaggccagtcaccggtcaccagccgagtagcgcgccaggggcgatgggacacgaacgagacgcgacgtggcgttggtggccggcggggtcgtccggtgcacgcgcgagcactccactcgatcggcgggggcgccggtgcgcgcgcggcgcagtgcggtgtggtcggcgtcgttgaccttcccttgtgtacgatgcgatcgattgccttgtaaacttttagcccagaaacatcatgacgcaacacagagagagagagagagagagagagagagagagagaaaagttcagaaacatcgtcctgttcctgtccgttgtctctaattaaataatgtcgtttggcaccgaaaaaaaaaaaaaaaaa

SEQ ID NO: 96466 - protein, 307 aa, Zea mays
  misc_feature: Ceres CLONE 1676175
  misc_feature (173)..(217): Pfam Name: CCT Pfam Description: CCT motif
MFRRSSPSPSYSDALMHNHAASFSAPLPVTVPPPRGAAAGGYLDGNVGAFSSPPSSYYNYNNIQRSVSSHSLPMRLQPGDVSLGGRGLYSPSSPSAHQLTPTLPPLSSSPSSSSGELFEFTSPCPVRRVFSTGDLQGMNGSSPPRPVLSGDGCGHEGGGTFSQKVVRYSAVERKERIERYRVKRHQRNFNKKIAYACRKTLADSRPRVKGRFARNGEADADADEREASDHSYEYGRSHDELGNGIAYSTTGSCYDGDNGEWWWRAPGASAAGDDDAQRQRQVRFDDDDDDDELWATLGDMMSMHLVS

SEQ ID NO: 96467 - DNA, 988 bp, Zea mays
  misc_feature: Ceres CLONE 1676974
  misc_feature: Encodes the peptide sequence at SEQ ID NO. 96468
aagttgcatagagaccggccggacgatggcagcagatgagcgcgaccgcgagcgatggatcctgcccggcgcgacggcgctggtcaccggcgggagcaaggggatcgggcacgcgatcgtggaggagctggcggcgctgggcgcgcgcgtgcacacgtgctcccgcaacgccgcggagctggaggagtgccgccggaggtgggcagagaagggcggcggccgcctgctgcagcaggtgaccgtctccgtctgcgacgtcgccgtgcgcgccgacagggaggcgctcatggccaccgtcagggacgtcttcggcggcaagctggacatcctcgtgaataacgcggcgcaggtggtcttcaagccggcggtggagtgcaccggggaggagtacgcgcggatcatggcgaccaacctggagtcctgcttccacctcagccagctcgcgcacccgctgctccgcaacgcctccctcgccggcggcgggagcgtcgtgcacatctcctccaccgcgggcctcctcggctttccaggggcggtgctttacagcactgcgaaaggaggagtgaaccagctcacgaggagcctggctgctgagtgggcctgcgacaagattcgtgtcaactcggtcgcgccaggaatcgtcatgactgacatggttaagaacgcagcaagctcggaggccgtcgagcaagaaacttcacggattccgctgcggcgggccggcgagccggcagaggtggcgtccgtggtgtcgtttctgtgcatgccggcggccgcctacgtcaccggccaagtcatctacgttgacggtggccgaaccataagcgcttgacgatgaccagcatcatcatcatctacgtctacgtggaatctaacaaacgcactccatccacaaacctaactacagtggcacgggattttacatatatgtagccacacacatgtgtgtgtgataaataaaagaattctttatgcaaaaaaaaaaaaa

SEQ ID NO: 96468 - protein, 268 aa, Zea mays
  misc_feature: Ceres CLONE 1676974
  misc_feature (16)..(192): Pfam Name: adh_short Pfam Description: short chain dehydrogenase
  misc_feature: SWISSPROT Homolog: EC 1.1.1.206 Tropine dehydrogenase
MAADERDRERWILPGATALVTGGSKGIGHAIVEELAALGARVHTCSRNAAELEECRRRWAEKGGGRLLQQVTVSVCDVAVRADREALMATVRDVFGGKLDILVNNAAQVVFKPAVECTGEEYARIMATNLESCFHLSQLAHPLLRNASLAGGGSVVHISSTAGLLGFPGAVLYSTAKGGVNQLTRSLAAEWACDKIRVNSVAPGIVMTDMVKNAASSEAVEQETSRIPLRRAGEPAEVASVVSFLCMPAAAYVTGQVIYVDGGRTISA

SEQ ID NO: 96469 - DNA, 1663 bp, Zea mays
  misc_feature: Ceres CLONE 1677156
  misc_feature: Encodes the peptide sequence at SEQ ID NO. 96470
actccaaatccaaattggtaaatttcccaaatccggtgcccccacaccggcatcctcacctcgtcagcgccgccggccttccttccattctccatccccgctcagtcggataggcgccggttggggaaaattctgttcggactgttcatcttgtcggcatgtctcattatcacagcgccgattttgaagagatggaggatgagtacgacatgaacgagccagtcgatgacatggagggggaggatgagtaccaagagctcgtgattagggactctgatgcggaggatgaagacgatgcggaccaattgcataagctctccgacacttcagcagcagatgcaagaagtgggaaagatattcaaggaataccctgggagacgatagaagtcacaagagaaacgtacaggcaggcccgactagagcagtacaagaactacgagaacatacctaattctggagtagcagcaatgatggcatgcaaatcaaccgagaaaggaagaacatattatgaattcagacgaaatactagatctgtgaaatccactatctctcactttcagctgagaaatttagtatgggcaacatcgaagcatgatgtctacctgttattgcattactctgtacttcactggtcggccttaaatggtgtggatacagaaattatggatgtacatggacatgttgcaccgagtgagaagcacccaggaagcttattagaaggttttttgcatactcaaattagtaccatggcagtgaaggataatttgttagtagctggtggttttcaaggagagctaatatgcaaacacctagatcgagaaggaataagcttttgctgcaggacaacatatgatgataatgcaattaccaatgcattggagatattcaatacatctagtggagctcttcacttcattgcatctaacaatgactgtggggtaagggagtatgatatggaaagatatcagttgtttaagcatttccgattcgattggccagtgaatcacacgtcattgagccctgatggaaagcttgttattattgttggtgatgacacagatgctttacttattgattctaattcaggaaagactattcattccatgaaaggtcacttggatttctcctttgcttcggcttggagcccagatggcctgacattcgccactggtaaccaagacaaaacttgtcggatttgggatgccaggaatctcaccgagtctgtccatgtcttgagaggcaacgttggagcaataagatctattcgttttacaccagacgggcacttcttgtcgatggcagaagcagcagactttgtccacatctttgacatcaaaagtgactacaataagagacaggaattggatttctttggcgaggtatccggtatgtccttcagccccgacacggacacactttatgttggaatctcggacaggacatatggcagcctacttcagtttggccgcctgtacaattattcatacctcgactcactactatgaaggtcaaagaaaatatgtgttttccctcggcttataatcaacccagattaggcatcccaaatgaaatttaatttagcctggtattcctcgtaaagaatcctgtaccctggtgtatgtgtacataaaaaaactgtattttataaaaaaaaaaaaaaaaa

SEQ ID NO: 96470 - protein, 448 aa, Zea mays
  misc_feature: Ceres CLONE 1677156
  misc_feature (310)..(348): Pfam Name: WD40 Pfam Description: WD domain, G-beta repeat
  misc_feature: SWISSPROT Homolog: EC 2.3.1.48 Histone acetyltransferase
MSHYHSADFEEMEDEYDMNEPVDDMEGEDEYQELVIRDSDAEDEDDADQLHKLSDTSAADARSGKDIQGIPWETIEVTRETYRQARLEQYKNYENIPNSGVAAMMACKSTEKGRTYYEFRRNTRSVKSTISHFQLRNLVWATSKHDVYLLLHYSVLHWSALNGVDTEIMDVHGHVAPSEKHPGSLLEGFLHTQISTMAVKDNLLVAGGFQGELICKHLDREGISFCCRTTYDDNAITNALEIFNTSSGALHFIASNNDCGVREYDMERYQLFKHFRFDWPVNHTSLSPDGKLVIIVGDDTDALLIDSNSGKTIHSMKGHLDFSFASAWSPDGLTFATGNQDKTCRIWDARNLTESVHVLRGNVGAIRSIRFTPDGHFLSMAEAADFVHIFDIKSDYNKRQELDFFGEVSGMSFSPDTDTLYVGISDRTYGSLLQFGRLYNYSYLDSLL

SEQ ID NO: 96471 - DNA, 925 bp, Zea mays
  misc_feature: Ceres CLONE 1677184
  misc_feature: Encodes the peptide sequence at SEQ ID NO. 96472
aagtgtctgcgcatgcatgcgcgtagtcgtccgctccccgcgcttgtcgtccagcctcttgctctgcagcagactcttcttgcctccccaaggagatctcccggcctagctccgtccagttggccaagccggagcacaaagcttgtgtgtctggctgtctccggccggccgggcttgtcgtacgtcctccaatctgttgacggtcaggccctctagcttttgctcggcgttctggagacagagcgagagcgagagagagagagagagagaggtagacggagatggagtgcctgctggggctgctcaaggtgcgggtggtgcgaggagtgcacctggccatctgcgacccgctcacccacagcagcgacccctacgtcgtcctccgccacggaaagcagaaagtgaaatcaagtataaaataccgcacgatcaacccagaatggaacgaggagctcaccctgtccatcacgaacatgatgaacccggtcaagattggactcttcgaccacgacacgttcaccaaggacgacagcatgggcaacgccgagttctgcatcctcaacttcgtggagatcgcgaagcaggacctgagcgacgtccccgacggcacggtgataaagacgatccgcccggagaagggcagctgcctcgccaccgagagccacatcacgtggaaggacggcaaggtctcccaggacatggtgctcaagctcagggacaccgagaccggagagctcgtcctgcacctcacctgggtcaacatcccaggcgtcgcgatgtgaatcccctgctgcatgaggcggcgacgcctgcccagctggttttactacactaaatatatacgattatacgatatgaagtctgtaaatgtggctccgtacgtttaccaggtattggcaaacaaggagaccctgcaaaaaaaaaa

SEQ ID NO: 96472 - protein, 166 aa, Zea mays
  misc_feature: Ceres CLONE 1677184
  misc_feature (8)..(89): Pfam Name: C2 Pfam Description: C2 domain
MECLLGLLKVRVVRGVHLAICDPLTHSSDPYVVLRHGKQKVKSSIKYRTINPEWNEELTLSITNMMNPVKIGLFDHDTFTKDDSMGNAEFCILNFVEIAKQDLSDVPDGTVIKTIRPEKGSCLATESHITWKDGKVSQDMVLKLRDTETGELVLHLTWVNIPGVAM

SEQ ID NO: 96473 - DNA, 1404 bp, Zea mays
  misc_feature: Ceres CLONE 1677337
  misc_feature: Encodes the peptide sequence at SEQ ID NO. 96474
aatctgccgcctcctctgtccaccctgtccccagcttatccaggaaggcacagccaggaacgcatcgtcactcaccagcaacatagtgattaaaggagcgagcagaggacttgttctctaccagccgcggccactcctcccacagctcgcggtcctcgaaatgttcaggggctgcggcctgttcgtctgcgcccgccgggggcgcggcgacctcaggaagcgtggcgagctaggcggcgcgagctcgcgggtggcgccagccgagccggtgtgcgtggacgaggcagaggacagcggcgccacgcggcagctggcgtgggcggaggtggaggccgccacgggtggcttctcgtccaaggtggtcggccgcggcgggttcagcacggtgtacctcgcctcgctccccacctcgtcgcggctcggcgccgtcaaggtgcactgcagcagcgagcgcctgcaccgcgcgttccgccgggagctcgacgtgctcctctccctccgccacccgcacgtcgtccgcctcctcggatactgcgacgagcgggacgagggcgcgctggtgttcgagtacgcgcccaacggcgacctccacgagaggctccacgggggcgcggccggcgtccaggtcctcccctgggcgcgtcgcgtggcggtcgcgttccaggtggccacggcgctggagtacctccacgagggccgcgacccggccgtcgtccacggggacgtcaaggcctccaacgtcctcctcgacgccggcatggacgccaggctctgcgacttcggcttcgcccacgtcggcgtcgcggccacgatgggcgggcggccctccgatcgcgccgtcatgggatccccgggctacgtcgaccctcacctcctccgctccggagtgcccaccaagaagagcgacgtgtacagcttcggcgtgctgctgctcgagctcttgacgggcaaggaggccgtctgccgcgagacagggcaccggctcacggccgcggtgaggcccaagctcagcgacggtcaattgccggacgtcctggacccgaggctgcgaggagactgcgacgtcgctgaggcggccgccgtggcggagctcgccatgcagtgcgtgagtgatagccccgggctccgaccgtccatcgccgacgtggtgcgcgtgctccaggagaagacctccgccgatggatcgagattgggcggcaagatgttgtcgtaagatagatgaacggcgcagattgtaaatatctccttgatggcgctagaattatgttgagggtagctagcagaagaattggtgcagtgagagatgaggtagggattaaaaatcaaagctttgaaatcactagatctgatagaaaaattttgtcatgcaactatgagtgttggttgtaaaaaaaaaaaaaaaaa

SEQ ID NO: 96474 - protein, 350 aa, Zea mays
  misc_feature: Ceres CLONE 1677337
  misc_feature (62)..(333): Pfam Name: Pkinase Pfam Description: Protein kinase domain
  misc_feature: SWISSPROT Homolog: EC 2.7.11.1 Non-specific serine/threonine protein kinase
MFRGCGLFVCARRGRGDLRKRGELGGASSRVAPAEPVCVDEAEDSGATRQLAWAEVEAATGGFSSKVVGRGGFSTVYLASLPTSSRLGAVKVHCSSERLHRAFRRELDVLLSLRHPHVVRLLGYCDERDEGALVFEYAPNGDLHERLHGGAAGVQVLPWARRVAVAFQVATALEYLHEGRDPAVVHGDVKASNVLLDAGMDARLCDFGFAHVGVAATMGGRPSDRAVMGSPGYVDPHLLRSGVPTKKSDVYSFGVLLLELLTGKEAVCRETGHRLTAAVRPKLSDGQLPDVLDPRLRGDCDVAEAAAVAELAMQCVSDSPGLRPSIADVVRVLQEKTSADGSRLGGKMLS

SEQ ID NO: 96475 - DNA, 1092 bp, Zea mays
  misc_feature: Ceres CLONE 1677385
  misc_feature: Encodes the peptide sequence at SEQ ID NO. 96476
agagaggcgaggagagacgccgccggactgccgtgcccagcgcccgtgaccatcccatcccatccggtcggtcgtacatgaaggaccgccgtggcagctcctccgtcggcggcggcgagcgcttcgccgtcttccccttctccatgggctgcatgtcgcagtccgccgtgtccgtcgccgaccccggcgacaagaaggcgcagggggacccgtcatccactgccgccacggtggctcgggcagcagcagcaggttcatcggaagaaggcgccggcgaggccatgacgaaggagaaggccgtggcgtcgtcggcggcggcgacgccggggctcgtggcggccggggtgtcgaggctgatgaaggggatccggagcctgtcgcagatgttcgcgggggaggacggcggcgaagatgaggatgaagacgagaaggaggaggatgacgaggagcgggagatggtgatcgggtaccccacggacgtgcagcacgtggggcacatcggctgggacggccacaacagcaaggcgggcgccgccgcggccatggctggcatggtgaacgccttctccctgccttcctccctctccctccgccacctcgacatggccatggaccgcgccgtcgcgcacgcctccgcctgaacccggcctgatgaccgcgcgcagctccgacggccggtatcgtacgtcgctactagattccgcggttccgccatttgattgcttcacacgttcgtacgcggagaaggaaggatatgatcgattcccatgcctccagtttgctgctgcttgttaatgccgccggccggtccctgttcttgccagtccagtgccatacgtgcgtgaaagtctctcgctttctgtgtcatatcatatccggtgtgagctactatagcgtagagcatgagacgacaagcgtatttgtgtacatacgtgcatgccaacttgtatagtttgtgaggcttcgccatcacacaccccacggtgcctgctggagctcatgtcagtatgtgtgtgtgtgtgcctgccactgccagtgacctatataactctgcgtgtgatttgtaattaaaaaaaaaaaaaaaaaaaaaaa

SEQ ID NO: 96476 - protein, 187 aa, Zea mays
  misc_feature: Ceres CLONE 1677385
MKDRRGSSSVGGGERFAVFPFSMGCMSQSAVSVADPGDKKAQGDPSSTAATVARAAAAGSSEEGAGEAMTKEKAVASSAAATPGLVAAGVSRLMKGIRSLSQMFAGEDGGEDEDEDEKEEDDEEREMVIGYPTDVQHVGHIGWDGHNSKAGAAAAMAGMVNAFSLPSSLSLRHLDMAMDRAVAHASA

SEQ ID NO: 96477 - DNA, 1267 bp, Zea mays
  misc_feature: Ceres CLONE 1677571
  misc_feature: Encodes the peptide sequence at SEQ ID NO. 96478
agtgctgcgcagatagcgtggcgccaaaccagcgccgtccaactgaaccagtggacagggctcgaggaggcagccccgcactacactactcgagggaagcagggaaccgtcgaaccgaggccccgtccgtcccaactcacgtgtacgtactcctcctgtcctgctgactgatccgcatgctgccggtcgtccaccgccgatcgtgaaacgcaaccgtcgccgtacgttcgtcgctagcttgccgccgatcgccgacctcgcgcgcggacactcacacacatggtcatggcgcctcagccttcgcgcgctctgagtccgaggctgagccgcgcccccggcgccggccacgcgtcgtgcaggtgctcggcagcgctcgcgccgctcttcgggaagcgcccggcgcccctcgtggtgtcgttcccgcgcgccggcagcggcggcgccgtcgcctcctgctcggccgtgccggtgcaggagtcgtccacctccaccgctgttagcaagaagaaggacggtgccaataaggaggccacagcggccaagccgaagaaggccgcggcgctgccgctgccggagatgatgcaggaggagatcatcccgccgctgaaggccgccttggaggcggaggaggacgtgtcccaggtccagctcgccttcgaaaacaacacgctagagggatccttcataaaggacgacgtcccttattgtttctgggccttctttccaaaaggagacctcacaggacccaagggcttcgcgctatcgtcctacagcaacgaggtgagcaccatcgagccgttcctgatcgacgagaagagggtaacggccaagtacgtggtgttctgggtttacaagaggctggctgggcaaggcatccttccggtctggaaggaagaggagggggaggatcatcaggacgccaagtagaacacacgcaggaggcaggagggtgctgctgtgaacctacacacagtcatcatgtctgaaactgttaaagttcgtctgctaatatatatacagatgctaagagctgctgagacacatgcatttcagcatttggcttctgctgcataggcgcatagccattcgcagtcgcaatcccttcgtaatcttgtgctgcagaagccagtcaaatttgttgaacaatcgaaaccttcgtgggccgggatcgacgacgagtcccgtctgaaagctatggtatctgaatattattaaaaaaaaaaaaaaaaaaaaaaaaaaaaaaaaaaaagaaaaaaaaaaaaaaaaa

SEQ ID NO: 96478 - protein, 215 aa, Zea mays
  misc_feature: Ceres CLONE 1677571
MVMAPQPSRALSPRLSRAPGAGHASCRCSAALAPLFGKRPAPLVVSFPRAGSGGAVASCSAVPVQESSTSTAVSKKKDGANKEATAAKPKKAAALPLPEMMQEEIIPPLKAALEAEEDVSQVQLAFENNTLEGSFIKDDVPYCFWAFFPKGDLTGPKGFALSSYSNEVSTIEPFLIDEKRVTAKYVVFWVYKRLAGQGILPVWKEEEGEDHQDAK

SEQ ID NO: 96479 - DNA, 1589 bp, Zea mays
  misc_feature: Ceres CLONE 1677785
  misc_feature: Encodes the peptide sequence at SEQ ID NO. 96480
tgagccagccagtgctagcgcatcgagaccagcaagtgtgcaccaagctgcgtgctacgtgtagtagctatagctagagagtagtgtgatcacgcagacacacacgcacacgcaaatatcttacatgcgttacgtagctgccactccgaccatgccgtcccttgtcgcggagagcgccgccgaaccgcctctggtggacagctacctggagctgctccggcgcggcggcggcggcggcggcattgcggcggcgaccgagggctgcgtgcaggagcgcgagctgcccttgatcgacctgacgtgcctgcagggcagcgcgggcgaggcggcggcgaggacgacgtgcgcggacgccatggcgagggcggcctcggagtggggctttttccaggtgaccgggcacggcgtgagccgggcgctgttggagcggctgcgggcggagcaggcgcggctgttccggctgccgttcgaaaccaaggccaaggccgggcttctcaacggctcctaccgctggggcgctcccacggccacgtcgctccgccacctctcgtggtcggaggcgttccacgtcccgctcgccagcatctccggcactgcctgcgacttcggagagctcagctccttgagggacgtgatgcaggaggtggcggacgcgatgtcgcgggtggccaagaccgtggcggtggcgctggcggggagcctgctgggccacgacgaggcggcggcgttcccggcggggtgcggcgagaccacctgctacctgcggctgaatcggtacccggcgtgcccgttcgcggcgaacaccttcgggctggtgccccacacggacagcgacttcctgacggtgctgtcccaggaccaggtcgggggcctgcagctcatgacggacgccggctgggtggccgtcaagccccgccccgacgcgctcatcgtcaacatcggcgatctgtttcaggcctggagcaacaacctgtacaagagcgtggagcacaaggtggtggccaacgccacggcggagcgcttctcggcggcctacttcctgtgcccgtcctacgactcgctcgtcggcacgtgcggcgagccgtcgccgtacagagacttcaccttcggggagtacaggaggaaggtgcaggaggacgtcaagaggaccggaagaaagattgggctccccaactttctcaaacaccggccaccccctcaatcacggcccgcctaaaattgacaagtcaaagcacctgccgttttgctctcgagaaatgacgagagcacctttttctcctgtaacttcacggtggatgcgagcacgacctcactgtgtacaagaaatatatataatatatatgaaccctttgaggcgcttgcttctttttctttttctttttctttgcttagctcatatatagtagaggtcactgtacaagaaagtgaacgaggacgacgcgtgcctgtgcctgtgcgcttatcaagctatcctcattatataacttcagcgatttccgctggaagaaaacgtttatctacatatattgtactacccctcttgcacaaaaaaaaactactttactttcaataaaaaaaaaaaaaaaaaa

SEQ ID NO: 96480 - protein, 363 aa, Zea mays
  misc_feature: Ceres CLONE 1677785
  misc_feature (209)..(308): Pfam Name: 2OG-FeII_Oxy Pfam Description: 2OG-Fe(II) oxygenase superfamily
  misc_feature: SWISSPROT Homolog: EC 1.14.11.13 Gibberellin 2-beta-dioxygenase
MRYVAATPTMPSLVAESAAEPPLVDSYLELLRRGGGGGGIAAATEGCVQERELPLIDLTCLQGSAGEAAARTTCADAMARAASEWGFFQVTGHGVSRALLERLRAEQARLFRLPFETKAKAGLLNGSYRWGAPTATSLRHLSWSEAFHVPLASISGTACDFGELSSLRDVMQEVADAMSRVAKTVAVALAGSLLGHDEAAAFPAGCGETTCYLRLNRYPACPFAANTFGLVPHTDSDFLTVLSQDQVGGLQLMTDAGWVAVKPRPDALIVNIGDLFQAWSNNLYKSVEHKVVANATAERFSAAYFLCPSYDSLVGTCGEPSPYRDFTFGEYRRKVQEDVKRTGRKIGLPNFLKHRPPPQSRPA

SEQ ID NO: 96481 - DNA, 951 bp, Zea mays
  misc_feature: Ceres CLONE 1677914
  misc_feature: Encodes the peptide sequence at SEQ ID NO. 96482
agtcacactactcagccagcccgctctatctctttcctctatccaagccagaaaggtagaaaccccccggaaacaatttccggccatggcgaccgcagcccaccaggttgccgccaccttcctctcgttcctttcctcctccactcaccacctcgccccttcctccgtctccctcgggacaacctctgtcctacccgtctcccttcgggccgctggcacacgtggcccacggctcgcctaccgcctccggggccgccgcgtcggtgccgccgtcgcccagctccccaccacgcatccagaggtagtttctggggagaagaagatcagatggtcatcaagggctgtgcggtcttttgcgatggcagagctggaggcccggaagatgaggtaccctacgacaggcactgaggggctcctcatgggcattcttgttgaaggaactagtggtgcagcaaaacttttgcgggctaatggaatcacacttctcaaagtgcgtgaggaggcagcgaatgtgcttgggaaatcagaaatgttttactttagtcccatgcatccaccattgacagaagctgcacagcgagcccttgattgggctgtcaatgaaaaattgaaatcaggtgaggatggagaagtaaatgccaatcatttgctactggggatatggtcagatgacgagtcagctggtcataaaatcctgtattcgctcggatttgacgatgtgaaagccagtttactggccaaaacggctgacgaggaggctgcaatgagtcctagatagcaaagggagcacctaatctgttattcaacttacaagagatgtgttagggtcaacttacaagcgattgccatgccggtgcctgtaaaaacgttgcggtttgtttgccacggtgaatgcttgtgttcctttctcagctggatttgtgatcagctcatagaaaaaaaaaaaaaaaa

SEQ ID NO: 96482 - protein, 230 aa, Zea mays
  misc_feature: Ceres CLONE 1677914
  misc_feature (93)..(145): Pfam Name: Clp_N Pfam Description: Clp amino terminal domain
MATAAHQVAATFLSFLSSSTHHLAPSSVSLGTTSVLPVSLRAAGTRGPRLAYRLRGRRVGAAVAQLPTTHPEVVSGEKKIRWSSRAVRSFAMAELEARKMRYPTTGTEGLLMGILVEGTSGAAKLLRANGITLLKVREEAANVLGKSEMFYFSPMHPPLTEAAQRALDWAVNEKLKSGEDGEVNANHLLLGIWSDDESAGHKILYSLGFDDVKASLLAKTADEEAAMSPR

SEQ ID NO: 96483 - DNA, 1693 bp, Zea mays
  misc_feature: Ceres CLONE 1678127
  misc_feature: Encodes the peptide sequence at SEQ ID NO. 96484
aatcggccgcgtccggcgtcccgtccaaaaagggaaagcgatgcgcgtggcgtggcggcacttcctcctccgcctgcctcgcccgccatggccgcgcgcgccaaggccgccgccgtcgacgaccacgaccccatgccgccaccgctgccgctcccatggccgcgcccagcgccgctcctcgtcatgctgtccctgctcgccacggcctcctacctggccctcacgcgctttcccgccgcgctcctcccgatcgcccctcgctctcgcccccacgacgcgcccgcgcacgcgcccggggacagctgcgcggggttctacgcgggcgcggggccggcgcgcgaggtgtgggcgtccgtcgaggagttcggggccgtgggcgacggggccacgctcaacaccgcggcgttccggcgcgccgtcgcggagctgggcgcgagggccgtcggtgggggaggggccaggctcgacgtgccccccgggaggtggctcacgggcagcttcaacctcaccagccgcttcaccctcttcctgcaccgcggcgcggtcatcctcggctcccaggatccagaagagtggcctctcattacccctttgccgtcttacgggcgcgggagagagcggttaggaccacgccacatcagcctcattcacggagagggcttaaacgatgttgttattaccggtagcaacgggaccatagatgggcaaggtcatatgtggtgggagctatggcggaaccgaaccttgaaccacacgagaggccatctcatcgagcttgtgaactcaaccaacgtcctgatatccagtgtcacgctgagcaactcccctttctggacagtacacccggtctactgcagcaacgtggtgatgaaggatttgaccatactggctcccctggatgctccaaacacagatggcattgatccagactcgagctctgaagtttgcatcgaagactgctacatcgaaagcggagacgacctcgtggccgtcaagagtggctgggaccagtacgggatctcatttggcaagccgagcacgaacatcgtcatccagagggtttcgggcacgactccgacgtgctcgggcgtaggcttcggcagcgagatgtcaggaggcatatctaacgtgctcgtccgtgacctccacgtgtggaattcggcgcaggccgtgaggctcaagaccgacgtagggaggggtggctacatcaccaacatcaccatagccagtgtggccatggagaaggtcaaggtgccgataaggttcagccgaggcgcagatgaccatcctgacgacaggtatgacccggccgcgctgccgaggatcagcaacgtgctggtcagcgacgtcgtcggtgtacacctgcagcgagcaccgatgctggaggcagtgcctggcgcagtttatgaggggatctgcttcaggaacttcagcttcagagggataaggcggcagcaggacagcaggtggcattgcgagtctgtgtatggagaggcgcatgacgttttccctgcaccgtgtgaagagttcaggagagatggatcctcctcctggtgtggacttctttgaccaactactctatctagtagtagtacatactacagcgcccacaagttttgggagtggatgatataggttttttagattatacagacaaactcaattttttaaactctaaaaaaaaaaaaaaaaa

SEQ ID NO: 96484 - protein, 493 aa, Zea mays
  misc_feature: Ceres CLONE 1678127
  misc_feature (120)..(478): Pfam Name: Glyco_hydro_28 Pfam Description: Glycosyl hydrolases family 28
  misc_feature: SWISSPROT Homolog: EC 3.2.1.15 Polygalacturonase
MAARAKAAAVDDHDPMPPPLPLPWPRPAPLLVMLSLLATASYLALTRFPAALLPIAPRSRPHDAPAHAPGDSCAGFYAGAGPAREVWASVEEFGAVGDGATLNTAAFRRAVAELGARAVGGGGARLDVPPGRWLTGSFNLTSRFTLFLHRGAVILGSQDPEEWPLITPLPSYGRGRERLGPRHISLIHGEGLNDVVITGSNGTIDGQGHMWWELWRNRTLNHTRGHLIELVNSTNVLISSVTLSNSPFWTVHPVYCSNVVMKDLTILAPLDAPNTDGIDPDSSSEVCIEDCYIESGDDLVAVKSGWDQYGISFGKPSTNIVIQRVSGTTPTCSGVGFGSEMSGGISNVLVRDLHVWNSAQAVRLKTDVGRGGYITNITIASVAMEKVKVPIRFSRGADDHPDDRYDPAALPRISNVLVSDVVGVHLQRAPMLEAVPGAVYEGICFRNFSFRGIRRQQDSRWHCESVYGEAHDVFPAPCEEFRRDGSSSWCGLL

SEQ ID NO: 96485 - DNA, 1860 bp, Zea mays
  misc_feature: Ceres CLONE 1678310
  misc_feature: Encodes the peptide sequence at SEQ ID NO. 96486
acacgacccgcgcccattgcattgcatcgcattgcatccgtctctctcatctcacactccaccgatccatccatcgcatatccacaaagctcgcccagagtactactagtcgtgtagagtgctagactgatcggtccatggcggcggcggcgagcaggacggtgtgggtgaacggccccatcgtggtgggggcggggccggcggggctgtcggtggcggcgtgcctgcgggagcgcggggtgccgtccgtcgtgctcgaccgggccgactgcatcgcctcgctctggcagcgccgcacgtacgaccgcctccgcctgcacctgccgcgccgcttctgcgagctccccgggatgcccttccccgcccactacccggagtaccccaccaagcgccagttcgtggagtacctgcaggcctacgccgaccgcgccggcgtggagccgcgcttcaaccaggccgtcacgtccgcgcgctacgacgaagccgcggggctctggcgggtgcgcgcggaggacgtcctcgcctccagttccacttccacttccaccaccgagtacataggccgctggctcgtggtcgccacgggcgagaacgccgagcgcgtcgtcccggagttcgagggcgcccgggacttcgcggggcccgtctcccacgtcgccgagtacaagtgcggcgaggcgtaccgcggcaagcgcgtgctcgtcgtcggctgcggcaactccggcatggaggtctgcctcgacctctgcgaccacggtgcgctcccgtccatggtggtcaggggatcggtgcacgtcctgccgcgggagatgttgggcgtggccaccttctccgtcgccgtgttcctcctccgcttcctgccgctgcggctggtggacgccgtcctcgtcctcctcgcgcgcctcttcctcggcgacctggagaggctcggcatccggcgccccgcgtgcggcgggccgctccagctcaagaacgccaggggcaggacccccgtgctcgacatcggcgccctcgccaggatccgctccggccacgtgcgggtcgtgccggggatcaggaggctcttccgcggcggcgccgagctccaagacggccgccgcgtcgccgccgacgccgtcatactggccaccggataccacagcaacgtcccacagtggctcaagggaagcgatttcttcaccgaggaagggtacccaagggtggcgttcccgcacggctggaagggggagtcggggctctactcagtcggattcaccaggagaggcctctccggcgtctcctccgacgccgtcaaggtcgcgcaggacatcgccgtggagtgggagaagcagacctccaagagatgatgaacaactgaagatgatggatgcccatcatcagcttaattaccgacagatgatgaccgtcgtcatcattgatggcctctcgttgatggacgacctggtaactccacgtatcttgccatcacgcatgtgtgtccagaaagcagaactcgacataatgtgcccaaaggcttgtccaagcacgaattcagagatatagaggtgatcaacttggagctgacatgttctgggaaacagaggagagaagaagcgtcgtcgtcggcgctcggcggcggcgggaaaaactggagagcgggcgggcctcatctcatagggtgcttgggctggcaatggcaagaaggccggctggactgtgcgcgtcacgtagtcgtagagcccagattttgctgtacccatgggcccttataaattttatgtatggagttgacaacgagaaagaccgaataataaaatctccgtcggtttaaaaactacaaaaaaaaaaaaaaaaaaaaaaaaagaaaaaaaaaaaaaaaaa

SEQ ID NO: 96486 - protein, 402 aa, Zea mays
  misc_feature: Ceres CLONE 1678310
  misc_feature (16)..(394): Pfam Name: FMO-like Pfam Description: Flavin-binding monooxygenase-like
  misc_feature: SWISSPROT Homolog: EC 1.14.13.8 Flavin-containing monooxygenase
MAAAASRTVWVNGPIVVGAGPAGLSVAACLRERGVPSVVLDRADCIASLWQRRTYDRLRLHLPRRFCELPGMPFPAHYPEYPTKRQFVEYLQAYADRAGVEPRFNQAVTSARYDEAAGLWRVRAEDVLASSSTSTSTTEYIGRWLVVATGENAERVVPEFEGARDFAGPVSHVAEYKCGEAYRGKRVLVVGCGNSGMEVCLDLCDHGALPSMVVRGSVHVLPREMLGVATFSVAVFLLRFLPLRLVDAVLVLLARLFLGDLERLGIRRPACGGPLQLKNARGRTPVLDIGALARIRSGHVRVVPGIRRLFRGGAELQDGRRVAADAVILATGYHSNVPQWLKGSDFFTEEGYPRVAFPHGWKGESGLYSVGFTRRGLSGVSSDAVKVAQDIAVEWEKQTSKR

SEQ ID NO: 96487 - DNA, 596 bp, Zea mays
  misc_feature: Ceres CLONE 1678574
  misc_feature: Encodes the peptide sequence at SEQ ID NO. 96488
acagtatcttcagaagctatagctgcagcacacagattcacatatacctacgtactccagctcgaagcagacagagcatctagctagctagctagctagtggcaagagcgtccgtacgtgacctgtgagaaccgaccgagtgaacgatcatggcggcggcgtctctgctaggctcgtacaccggggacagcggcttgggcgggaggctcgtccacgccaggagcggcggccgccggccagctgcggcgatgaagcggctgttgtcgaggttgaggcgctcttggagaagacgcgcggcgcggccgaggcgaaccgcggtgaggttcggatatgacctgcatagctactaccagaacttcgacgacagcactgcctcctgcgcccaccacagttgtagctcgtgcagcagtgcttatgtttgctactatactaattgccggtgactattactagctagctgttggctgttgcagccatagactcactgtacaggatgatgctttattgtggagctatatatttgaagcttcgaatagaaatgagtttctgtatattattataaactgattctgagggcttcaaaaaaaaaaaaaaaa

SEQ ID NO: 96488 - protein, 97 aa, Zea mays
  misc_feature: Ceres CLONE 1678574
MAAASLLGSYTGDSGLGGRLVHARSGGRRPAAAMKRLLSRLRRSWRRRAARPRRTAVRFGYDLHSYYQNFDDSTASCAHHSCSSCSSAYVCYYTNCR

SEQ ID NO: 96489 - DNA, 1630 bp, Zea mays
  misc_feature: Ceres CLONE 1678745
  misc_feature: Encodes the peptide sequence at SEQ ID NO. 96490
aagtgcgctccattgcgtggttgctcctgctctcgcctctcgctattcttagccccagagctcgcgccacgccacaacacgtacctcccgcgcgcggggcgtgcaagcacacggctgccccggcccgcgcgcccgtgccggccggccagcagacatggacatcgacctcgaccgggcgcgcgcgctgcgcatcctcggccgcggcgccatgggcaccgtgttcctcgtcgcggaggggccctcggccttgcgccccagccgctacgccctcaaggtcttcgacaagcgctccgccgcccgcagcaggaagcctgacgccgaccgccgcgcgcggtgggagatcagcgtgctgtcccgccttgcgcacccgcacctcccctcgctcctcggcttcaccgagacggacgaccttctcgcgtgggccgtcccctactgctccggcggcgacctcaacgagctccgctactcgctccccgaccgcatcttctcccccgcggccatccgcttctacattgccgagatcgtctccgcggtcgccgagctccacgccgcgggcgtcgtgtaccgtgacctcaagcccgagaacgtgctcctccgcgccgacggccacgtcacgctcaccgacttcgacctgtcccgcctcctccaccccagcaggtcgtccgcggagtcgtcgtcgcccccgcggccagcgtcgtcccgcggccaccacaaccgccggtcgcgcgtccccgcgcggagcgactcggttctcagccagcaggtcaagtcgtactccaactccaacaactccaggccccctcaccagccctggtccgcggcgtcgtcgccgcggcagcagctccagagcctggtccgctacatcatggggagcggcgacggggccggggtgggcaggaagagcaagtcggcgcgggtgtcgccgctgagccggaagcccgcgagcttcggcggcagctcctccgccgccgcgtggggcaagtcctactccttcgtcggcacggaggagtacgtggcgccagagatggtgcgcggcgagggccacggcttcgccgtcgactggtgggccgtcggcgtgctcgcctacgagatggcgttcgggcggacgccgttcaagggccagaaccgcaaggagacgttccggaacgtgctgcagcaggagctcgagttcccgggggacacccggtggcggacgccggagctcgcggatctcatctcgggcctgctggagcgggacccgaggaggaggctcgggtacgccggcggcgccgacgaggtccgggcccacccgttcttcgccggcgtcgcgtgggacatgctcacggaggtgtccaggccgccttacatcccgccgccggccgacgaggacctcgcggacgtcgaagggttcgacgtgaggggccacttcaaggaccttcaccagccgccgcctcccaagtccgcgtcggagtcgtcctcgtccgagttctcgacggagttctgactgtgagctcgggctagcttcttttgcgctttggtcctcggtagattactatattgtaaccagagggtcgagggtgtctgtactgtacatacatggagacggggatggtgctgtaaaaaaaaaaaaaaagaaaaaaaaaaaaaaaaa

SEQ ID NO: 96490 - protein, 442 aa, Zea mays
  misc_feature: Ceres CLONE 1678745
  misc_feature (8)..(381): Pfam Name: Pkinase Pfam Description: Protein kinase domain
  misc_feature: SWISSPROT Homolog: EC 2.7.11.1 Non-specific serine/threonine protein kinase
MDIDLDRARALRILGRGAMGTVFLVAEGPSALRPSRYALKVFDKRSAARSRKPDADRRARWEISVLSRLAHPHLPSLLGFTETDDLLAWAVPYCSGGDLNELRYSLPDRIFSPAAIRFYIAEIVSAVAELHAAGVVYRDLKPENVLLRADGHVTLTDFDLSRLLHPSRSSAESSSPPRPASSRGHHNRRSRVPARSDSVLSQQVKSYSNSNNSRPPHQPWSAASSPRQQLQSLVRYIMGSGDGAGVGRKSKSARVSPLSRKPASFGGSSSAAAWGKSYSFVGTEEYVAPEMVRGEGHGFAVDWWAVGVLAYEMAFGRTPFKGQNRKETFRNVLQQELEFPGDTRWRTPELADLISGLLERDPRRRLGYAGGADEVRAHPFFAGVAWDMLTEVSRPPYIPPPADEDLADVEGFDVRGHFKDLHQPPPPKSASESSSSEFSTEF

SEQ ID NO: 96491 - DNA, 1534 bp, Zea mays
  misc_feature: Ceres CLONE 1678901
  misc_feature: Encodes the peptide sequence at SEQ ID NO. 96492
agtcgctttccgctttcctttgctgctgaccatatatctacggtagcaagacaagacaaggaagtcggctgatccatggcggccttcacggtgcacacgagcgccgccacctcgccctactcgccggcgggcacggccatccttctccgaagccggagtcgagcctaccccaccgccaccatccgcgtgtcgtgctcgaagacggtggtgatcggggtggcggcggactcagggtgcgggaagaccacgttcacgcggcgcctggcgagcgtgttgggcggcggggcggagccaccgagggccggccggaacccgggctccaacacgctcgtcagcgacaccaccacggtgatctgcctggacgactaccactcgctggacagggtcgggcggaaggcgaagggcgtcacggcgctggatccgaggttcgtcgacttcgacctcatgtacgagcaggtgagggccatcaaggagggccgcgccgtcgagaaacccgtctacaaccacgtcaccggcctcctcgacccgcccgagctcatcaccccgccgaacatcctcgtcatcaaggggctgcacccaatgttcgacgagcgcgtgagggacctgctagatttcagcatctacctggacatcagcaacgaggtgaagcttgcatggaaaatccagagagacatgggagagcgtggtgggcacagccttgagagcatcaaggcctccatcgaggcaaggaagcccgacttcgaagcttacattgagccgcagaagcagtacgcggacgccgtgatcgaggtcctgccgacgcagctgatcccgggcgacgacgagtgcaaggtggtgcgcgtgaagctgatcatgaaggaaggcgtggagcacttcgcccccgtgcacctcttcgacgaaggatccaccgtctactggatcccctgcggccggaagctctcctgctcctaccctggcatcaggttcgcctacggcttcgacacctacttcggacacgaggtgtcggtggtggagatggacgggcagttcgacaagctggacgagctcatctacgtggagacccacctgagcaacctgtcaaccaagttctacggggaggtgacgcagcagatgctcaggcacgccgacgtccccggcagcaacaacggcacggggctcttccagaccatcgtcgggctcaagatcagggacctctacgagcagatcgtcgcacgtcgctgaccatgacggccaaccctagcaaggtctcgtttttttgtcccatacaaacaatcaaacgcagaccgatacttgatcaatacatgtgcagagcctatttctgctcccacgggcaaccaaacacatcgattgtgttcgtgcgcatcagcacgggtgtagaatggataggcgtgtgtgtagttgtgtacaggctacacgcgtgttcggtccgatctttttgacagattcgtgcaatgtcgcgtgagttggtgtggatgtcggtacgtgggcattcttcttgcaaatgtccaggtcacactaaaaaaaaaaaaaaaaa

SEQ ID NO: 96492 - protein, 381 aa, Zea mays
  misc_feature: Ceres CLONE 1678901
  misc_feature (45)..(246): Pfam Name: PRK Pfam Description: Phosphoribulokinase / Uridine kinase family
  misc_feature: SWISSPROT Homolog: EC 2.7.1.19 Phosphoribulokinase
MAAFTVHTSAATSPYSPAGTAILLRSRSRAYPTATIRVSCSKTVVIGVAADSGCGKTTFTRRLASVLGGGAEPPRAGRNPGSNTLVSDTTTVICLDDYHSLDRVGRKAKGVTALDPRFVDFDLMYEQVRAIKEGRAVEKPVYNHVTGLLDPPELITPPNILVIKGLHPMFDERVRDLLDFSIYLDISNEVKLAWKIQRDMGERGGHSLESIKASIEARKPDFEAYIEPQKQYADAVIEVLPTQLIPGDDECKVVRVKLIMKEGVEHFAPVHLFDEGSTVYWIPCGRKLSCSYPGIRFAYGFDTYFGHEVSVVEMDGQFDKLDELIYVETHLSNLSTKFYGEVTQQMLRHADVPGSNNGTGLFQTIVGLKIRDLYEQIVARR

SEQ ID NO: 96493 - DNA, 636 bp, Zea mays
  misc_feature: Ceres CLONE 1678962
  misc_feature: Encodes the peptide sequence at SEQ ID NO. 96494
aatccccccgatcactctttcactctactccaaccactccgcggaatcgtaccttacccagccttcttcctcgtcgccgggctcgccgccagccatgtcggcggcgttcaaggcgttcctgaatagcccagtgggccccaagacgacccacttctggggacccgtctccaactggggcatcatcctcgcgagcgtggcagacacgaaaaagcctcctgagatgatatccggcaacatgacaggagtgttgtgcgtgtactctgcgctcttcgtcaggttcgcgtggatggtgcgacctcggaactatttcctcatggtaacccacagctgcaacgagtgcgttcagctctaccagctgtcgcgctgggctagggcgcaggggttctttgagaagaaagaagaggagaggcccaagagcgaagattgaccgacggcccggccctaaaccatacaatactacaatgtgctcggttgtaccacaaaggcaatatttgatgcatgtattgtaacgtgaaaaaaagcctcggttatacatgttgtaggttcatctgcggatattgaactatgaatttccgagcataaagcatcaatttccactgcaaaaaaaaaaaaaaaaaaaaaaaaaaaaaaaaaaaa

SEQ ID NO: 96494 - protein, 110 aa, Zea mays
  misc_feature: Ceres CLONE 1678962
  misc_feature (1)..(108): Pfam Name: UPF0041 Pfam Description: Uncharacterised protein family (UPF0041)
MSAAFKAFLNSPVGPKTTHFWGPVSNWGIILASVADTKKPPEMISGNMTGVLCVYSALFVRFAWMVRPRNYFLMVTHSCNECVQLYQLSRWARAQGFFEKKEEERPKSED

SEQ ID NO: 96495 - DNA, 1159 bp, Zea mays
  misc_feature: Ceres CLONE 1678999
  misc_feature: Encodes the peptide sequence at SEQ ID NO. 96496
aatccccaaccccaacccgtcgccggaaaattccaccgcacacgagaccagcaggcgaagaaaggcagctaactaggagaagcaaagatgccgtgcctccaggcgtccagccccggcagcatgccttaccagcaccacgggcgcggcgtcgggtgcgcggcggaggcgggcgcggctgttggcgcgagcgcggggacggggactcggtgcggggcgcacgacggcgaggtgcccgcggaggcggcgcggcaccacgagcacgcggcgccggggcccgggcggtgctgctccgcggtggtgcagcgcgtggcggcgcccgcggaggcggtgtggtcggtggtgcggcggttcgaccagccgcaggcgtacaagcggttcgtgcgcagctgcgcgctgctggcgggcgacggcggcgtgggcacgctccgcgaggtgcgcgtggtgtcgggcctgcccgcggcgtccagccgcgagcgcctggaggtgctggacgacgagagccacgtgctcagcttccgcgtggtcggcggcgagcaccggctccagaactacctctccgtgaccaccgtccacccgtccccggccgcgcccgacgccgccaccgtcgtcgtggagtcgtacgtggtggacgtgccgccgggcaacacccccgaggacacccgcgtgttcgtcgacaccatcgtcaagtgcaacctccagtcgctggccaccaccgccgagaagctcgcactcgcagccgtgtaggcgtgactgcgtgaggaggggactcccatctccatgggtgatctaatcgatagtttttcgggggaggagggatcagggatgcgtgagccttttttcttttatcccctctttctttagccttttcacattagtgccctctactcttggttttggttattattcttttttttctcgttgttgcgagagacaagcagcccttggcctccctctctagctagtcccttgcccaaacattgaagagatcaaagatgacaagtataaatcgatccgtagagatccaagttccggcgcacgctcgattcctctgtatatgtatatatatatatgttcatggtattatatagagacagatatggtgtatatgttcatgcaaaacaatgttatagtactgtttgttgaaaaaaaaaaaaaaaaa

SEQ ID NO: 96496 - protein, 218 aa, Zea mays
  misc_feature: Ceres CLONE 1678999
  misc_feature (74)..(207): Pfam Name: Polyketide_cyc Pfam Description: Polyketide cyclase / dehydrase and lipid transport
MPCLQASSPGSMPYQHHGRGVGCAAEAGAAVGASAGTGTRCGAHDGEVPAEAARHHEHAAPGPGRCCSAVVQRVAAPAEAVWSVVRRFDQPQAYKRFVRSCALLAGDGGVGTLREVRVVSGLPAASSRERLEVLDDESHVLSFRVVGGEHRLQNYLSVTTVHPSPAAPDAATVVVESYVVDVPPGNTPEDTRVFVDTIVKCNLQSLATTAEKLALAAV

SEQ ID NO: 96497 - DNA, 939 bp, Zea mays
  misc_feature: Ceres CLONE 1679296
  misc_feature: Encodes the peptide sequence at SEQ ID NO. 96498
aatcagctcggggcgcagagctttgggaattccaagcagagccagcacagccacagcccacagcccacagcccgggaggagaagcgagcgcgcgatccagttggtggccgcccccgcccgcacaccatggcgacgccgtggtggtggccgtcgctgctgccggcgtggctgagctccagcgcgctatggttcctcgtcgccaacgcggtcgtcgccgcggtcgccatcctgtccaggcgcccgccgctgccgctgccgctgccgctgccgtcgccccgccgccgccgccgcagcagcggcgccgccgccgcgctcacgcggagggcctcgtctgcgctgctgcagcgcctccgctccttctccatcttcgccgtcccctccgcctgcttcaacaccaccacgccgtttccgcaccccgacgccgcccaaggaacagaaactgaggcgccggccaggacaccggcgtcccctctctcgtcgctgggccgcgcgccggcggcagacgccgacgaggaggatagcgagcccggcgggatgagcatggacgaggcctacgcgctggcgctggaggcgcgccgccggccggaccgggagagggaggaggcgcccaggaggtccgaggtggacgccaagcccgaggagttcatccgcggcttcgaggaccaccaacgccagcagcgcctcaactccatcttcaactacacccagatgctcaagcagcgcgccgccgccgcccgccgccagcgccagccggatgccccgccagatcagctttgagtcacgtgttcggttcgttcgttcctgatattggtcagcgttttcagggagaccaaaatcagttttgagttgctgtacatagcctgctttcaacagattgtttgtatatagtcaccagatatgatttacagataaagtacgacataaagataaaaaaaaaaa

SEQ ID NO: 96498 - protein, 216 aa, Zea mays
  misc_feature: Ceres CLONE 1679296
MATPWWWPSLLPAWLSSSALWFLVANAVVAAVAILSRRPPLPLPLPLPSPRRRRRSSGAAAALTRRASSALLQRLRSFSIFAVPSACFNTTTPFPHPDAAQGTETEAPARTPASPLSSLGRAPAADADEEDSEPGGMSMDEAYALALEARRRPDREREEAPRRSEVDAKPEEFIRGFEDHQRQQRLNSIFNYTQMLKQRAAAARRQRQPDAPPDQL

SEQ ID NO: 96499 - DNA, 1035 bp, Zea mays
  misc_feature: Ceres CLONE 1679536
  misc_feature: Encodes the peptide sequence at SEQ ID NO. 96500
aggcaagaaccaacgtgctcgatctccatctcgaccgtcgctcaccgggaagctacgctacgacgaagcatggcgtccgtcaccgcccgcgccccggtcgcggccctgcgcccgtcggcgtctctcaagtcgtcgtcgtcgtcggcggcggccttccttggccactctagccgcctcggccgcactgctaccgcgtcgccgacgaggcgcagcctaaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaggtgctgaccaaggccgggctgatcaacgcgccgcagtggtacgacgccggcaagtcggagtacttcgcgtcgtcgtcgacgctgttcgtgatcgagttcatcctgtttcactacgtggagatccggcggtggcaggacatcaagaaccccggcagcgtcaaccaggaccccatcttcaagagctacagcctgccgccgcacgagtgcggctaccccggcagcgtcttcaacccgctcaacttcgcgcccacgctcgaggccaaggagaaggagctcgccaacgggaggctggccatgctggcgttcctggccttcctgatccagcacaacgtcaccggcaaggggcccttcgacaacctgctgcagcacctgtccgacccatggcacaacaccatcatccagaccctgtcgggttgagtcgacggtccatcaggtcatgtggtccgagctgaaaggccgagactcgaagacagttcgtgtgatgcgttcttaatcgactgagggctaaggaatgtgacgtactggtatatgtacattagttgaagcggaggctataaagggtgtagagattgtttcatcagtatatatcatctgtcccgatgggtttaaaaaaaaaaaaaaaaa

SEQ ID NO: 96500 - protein, 252 aa, Zea mays
  misc_feature: Ceres CLONE 1679536
  misc_feature (62)..(224): Pfam Name: Chloroa_b-bind Pfam Description: Chlorophyll A-B binding protein
MASVTARAPVAALRPSASLKSSSSSAAAFLGHSSRLGRTATASPTRRSLKAEAKGEWLPGLPSPAYLDGSLPGDNGFDPLGLAEDPENLRWYVQAELVNGRWAMLGVAGMLIPEVLTKAGLINAPQWYDAGKSEYFASSSTLFVIEFILFHYVEIRRWQDIKNPGSVNQDPIFKSYSLPPHECGYPGSVFNPLNFAPTLEAKEKELANGRLAMLAFLAFLIQHNVTGKGPFDNLLQHLSDPWHNTIIQTLSG

SEQ ID NO: 96501 - DNA, 939 bp, Zea mays
  misc_feature: Ceres CLONE 1679636
  misc_feature: Encodes the peptide sequence at SEQ ID NO. 96502
agttctactgtgccagccggaacatgtcaaccacaggccagcgaagctcccgtctccggccgtggaggaagcaagtacctataaatacgcccccgcaagcaagcccgcgccagcgccaccgacccagctgcaaacggccggccatggactccaccgagcccccgccggcgtcgccttcctcgcccgggccaccaggcggccagccgtccccgccgaagcggcccgcggggcgcaccaagttccaggagacgcggcacccggtgttccgcggggtgcggcggcgcgggcgcgcggggcggtgggtgtgcgaggtgcgcgtgccgggcagccgcggggaccgcctgtgggtgggcacgttcgacacggccgaggccgccgcgcgcgcgcacgacgccgccatgctcgcgctctgcggcgccgccgccagcctcaacttcgccgactccgcctggctgctccacgtgccgcgcgcccccgcgggcctgcccgaagtccagcgcgccgccaccgacgccgtcgcggcgttcttgcggacgcagcaaccgcgcggcggcggggacgcgcccgccgccgcctcgcagggtcagcgcgccaatgccgccacggagacggagttggaccacgccggcgcgtcggcggcggcggtggacggtggcggcggcagcgtggttgaggtggatgtgttcggcggcatggacgacgccgggtcctactacgcgagcctggcgcaggggctgctcatcgacccgccgccgcccgccgtagagtgccccgaggaggaggatgacgattgcggcggcgctggtgagatggagctgtgggactagccacctagctctagccgccccccgagttaggagtagggcagaggattaacgaacgctgtgcgtgcccgcaaacaaaacaatctgattttcgttttaaaaaaaaaaaaaaaaa

SEQ ID NO: 96502 - protein, 267 aa, Zea mays
  misc_feature: Ceres CLONE 1679636
  misc_feature (79)..(132): Pfam Name: AP2 Pfam Description: AP2 domain
MSTTGQRSSRLRPWRKQVPINTPPQASPRQRHRPSCKRPAMDSTEPPPASPSSPGPPGGQPSPPKRPAGRTKFQETRHPVFRGVRRRGRAGRWVCEVRVPGSRGDRLWVGTFDTAEAAARAHDAAMLALCGAAASLNFADSAWLLHVPRAPAGLPEVQRAATDAVAAFLRTQQPRGGGDAPAAASQGQRANAATETELDHAGASAAAVDGGGGSVVEVDVFGGMDDAGSYYASLAQGLLIDPPPPAVECPEEEDDDCGGAGEMELWD

SEQ ID NO: 96503 - DNA, 1334 bp, Zea mays
  misc_feature: Ceres CLONE 1679724
  misc_feature: Encodes the peptide sequence at SEQ ID NO. 96504
aatctccatatatacaagcagatcaaagatcgatctcatcgatcatggcaactaccaatgctggcaatgaccattgctggccagaacccattgtgcctgtacaaaccctttcaaactctggcgtgtccaccgtgccacagcgatacatcaaacctccatctgagcgtcctaacggtactggtagcatgaactgttgtgacgacgacgatgtcgtcgccagcatccctatcgttgaccttgcacgcggcttctcctcctccgccggcgggggcatccctgacgacgacgagcatcgcgatcgcagagcggcggcggcgctggaagcagtcggtgacgcgtgcaagaactgggggttcttccaagtagtgaaccatggcgtgggcgtggattcggtggagaggatgagaggggcatggagggagttctttgacctgcccatggaggagaagaaaccgtacgcaaactcaccggcgacgtacgagggctacgggagtcgccttggggtcgagaaaggcgcagccttggattggggtgactattactacctaaacctcctgccagacgataccaagaacctcgacaagtggccagagatgcctcgtcagctgagggaggtgactgagaagtatgcatgtgatctgatggagctgagccaagtgttgctgaaggccatgtcaagcaccttaggattagacgaggactacctccacatggccttgggtggaacaaccaagaagggcatctcagcaagcatgcgtgtgaactactacccaaagtgcccagagcctgagctgacactgggcctctcgtctcactctgatcccggcggcatcaccttgctcctcctggacgaagatgtcaaggggacccaggtacgcagaggggacgacacgtgggtcacggtgcacccgatcccgggcgccttccttgtaaatgttggagaccaaatccagattttgagcaacggcgcgtacaagagcgtggagcaccgcgctctggctagctctggccatgaccgcctcaccattgccttcttctgcaacccttgcggcgacctccccatcgtgccggcgccccagctggtgggtcccgagtcaccggcggtgtacggccagccgcccatcaccttcaacgagtaccgcaagtacgtccgcaccaagggtgcccgaggcagggcgcaggtggagtcactctccatcagcaccaccagcaccagcaccaccaacaacaacaacaccagctagcttgttgatctaccagctatttcttaagtattgtttgccaatgtaattaataaatatgcatgtgcgtgtttataaaaaaaaaaaaaaaaa

SEQ ID NO: 96504 - protein, 399 aa, Zea mays
  misc_feature: Ceres CLONE 1679724
  misc_feature (233)..(334): Pfam Name: 2OG-FeII_Oxy Pfam Description: 2OG-Fe(II) oxygenase superfamily
  misc_feature: SWISSPROT Homolog: EC 1.14.11.19 Leucocyanidin oxygenase
MATTNAGNDHCWPEPIVPVQTLSNSGVSTVPQRYIKPPSERPNGTGSMNCCDDDDVVASIPIVDLARGFSSSAGGGIPDDDEHRDRRAAAALEAVGDACKNWGFFQVVNHGVGVDSVERMRGAWREFFDLPMEEKKPYANSPATYEGYGSRLGVEKGAALDWGDYYYLNLLPDDTKNLDKWPEMPRQLREVTEKYACDLMELSQVLLKAMSSTLGLDEDYLHMALGGTTKKGISASMRVNYYPKCPEPELTLGLSSHSDPGGITLLLLDEDVKGTQVRRGDDTWVTVHPIPGAFLVNVGDQIQILSNGAYKSVEHRALASSGHDRLTIAFFCNPCGDLPIVPAPQLVGPESPAVYGQPPITFNEYRKYVRTKGARGRAQVESLSISTTSTSTTNNNNTS

SEQ ID NO: 96505 - DNA, 616 bp, Zea mays
  misc_feature: Ceres CLONE 1680099
  misc_feature: Encodes the peptide sequence at SEQ ID NO. 96506
agcgccggccagttcaccgcccatctcgatcggtaaaattgcaccggcgatcgacgtacggtaggtcggtagtagcagcaaagaaactaaccatgaggcaggcgaggccgtactcggggatcttctgcggcggggtgtcggcgcggacgggcccgcacgcgctgccgctggcgcgcatcaagaagatcatgaagcgctccgcgggggaggcggcggccgccgcggacggcggcgccaggatgatctcctgcgaggcgcccgttgtgttctccaaggcgtgcgagctcttcgtcgccgagctcacgcgccgcgcctgggccgccacgctcgacggcaagcgccgcaccgtgcacagggaggacgtcgccacggccgtgcacaacaccgacctcttcgacttcctcgtcgacgtcgtcacggcggacactgcaggtggaaccggcggcggcggcggcgggcacgacggcgacggcccgctctaagctgcatggggacgaattttcagccgtttgcttgtgcctaattaaaaaaccacctgcccacacgatgctctggtgcggtgacttgtaccaacttctctcatgaaatcccattctccgaaaaaaaaaaaaaaaaa

SEQ ID NO: 96506 - protein, 129 aa, Zea mays
  misc_feature: Ceres CLONE 1680099
  misc_feature (22)..(95): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 1188 in the 10/412,699 US patent application
  misc_feature: The sequence is a functional homolog of SEQ ID NO 835 in the 10/374,780 US patent application
  misc_feature: The sequence is a functional homolog of SEQ ID NO 712 in the 11/479,226 US patent application
  misc_feature: The sequence is a functional homolog of SEQ ID NO 102 in the 10/225,068 US patent application
  misc_feature: The sequence is a functional homolog of SEQ ID NO 230 in the 10/714,887 US patent application
  misc_feature: The sequence is a functional homolog of SEQ ID NO 230 in the 11/435,388 US patent application
  misc_feature: The sequence is a functional homolog of SEQ ID NO 310 in the 10/412,699 US patent application
  misc_feature: The sequence is a functional homolog of SEQ ID NO 727 in the 11/479,226 US patent application
  misc_feature: The sequence is a functional homolog of SEQ ID NO 94 in the 10/374,780 US patent application
  misc_feature: The sequence is a functional homolog of SEQ ID NO 1190 in the 10/412,699 US patent application
  misc_feature: The sequence is a functional homolog of SEQ ID NO 837 in the 10/374,780 US patent application
  misc_feature: The sequence is a functional homolog of SEQ ID NO 1908 in the 11/479,226 US patent application
  misc_feature: The sequence is a functional homolog of SEQ ID NO 2126 in the 10/374,780 US patent application
  misc_feature: The sequence is a functional homolog of SEQ ID NO 314 in the 10/374,780 US patent application
  misc_feature: The sequence is a functional homolog of SEQ ID NO 846 in the 10/225,066 US patent application
  misc_feature: The sequence is a functional homolog of SEQ ID NO 1109 in the 10/374,780 US patent application
  misc_feature: The sequence is a functional homolog of SEQ ID NO 1108 in the 10/374,780 US patent application
MRQARPYSGIFCGGVSARTGPHALPLARIKKIMKRSAGEAAAAADGGARMISCEAPVVFSKACELFVAELTRRAWAATLDGKRRTVHREDVATAVHNTDLFDFLVDVVTADTAGGTGGGGGGHDGDGPL

SEQ ID NO: 96507 - DNA, 1012 bp, Zea mays
  misc_feature: Ceres CLONE 1680316
  misc_feature: Encodes the peptide sequence at SEQ ID NO. 96508
agctctccatccatccccgtcccccgcgatcgccgagctctacctcctccagcacacgtcccgcggcagcatccgtcagagaagctagctagcgcttcgatccccgatccgtgtcgtagacgacagcggggccccccggcggccggttgtttctcgcagctcggccggcggcggccatggacgacgacgcctcctcgtctccggcggcttcgtacatcagactggtgcagcatctgatcgagaagtgcatctgctacaagctgaacaaggaggagtgcatggagacgttggagaagcacgccaagatcatgcccgtcgtcacgtccaccgtgtggaaggagctagagaaggagaacagggagttcttcgagacgtacaagaaggatcggggaggaggaggaggaggccccaggaacctgcaggaagcggcggctgctggtcaccatcctcctccgcgtctccaagtccaacagagctgctgctcacaagagccggcgctggagcagaagaagcacccaccatctgatggagtacaggaacataatcgcgtcgtcgtggagaaggagaagaggaagcaggacccaccatcggcgtcggcgtcggctgatggacaggaacagcgcgtcgtggagaagaaggagaagaggaaggacccgccgtctgatggacaggaacggcgcgtcatggcgaaggagaacagccggaaggatccttccgcttcttccaagagatcagacaaggacaacgactagagctctcgctcgctcgatcagccgtgccgctcctgtggctacgatcgaatgtggttgatgcaggaggtacggtacatctatcgatcgagagagagagctgctctctctagctatctatagactatatatatatcagcatcggtcgccagtgtgattatgtgtgtaggaggctgcatgaccatgtgtattatgggtagacagattgattaaacctaaaaaaaaaaaaaaaaaaaaaaaaaaaagaaaaaaaaaaaaaaaaa

SEQ ID NO: 96508 - protein, 191 aa, Zea mays
  misc_feature: Ceres CLONE 1680316
MDDDASSSPAASYIRLVQHLIEKCICYKLNKEECMETLEKHAKIMPVVTSTVWKELEKENREFFETYKKDRGGGGGGPRNLQEAAAAGHHPPPRLQVQQSCCSQEPALEQKKHPPSDGVQEHNRVVVEKEKRKQDPPSASASADGQEQRVVEKKEKRKDPPSDGQERRVMAKENSRKDPSASSKRSDKDND

SEQ ID NO: 96509 - DNA, 1681 bp, Zea mays
  misc_feature: Ceres CLONE 1680828
  misc_feature: Encodes the peptide sequence at SEQ ID NO. 96510
agtgcacgctgtcacccagcacagagccacagacacaggcacatagccagcaagcaacggcgtggtggccatcgaaatggacatagctcaccgagactacctcctagtcaagctccacacttgcctcggcgtcgccaccctcctgctctgcgtcctcgccgagctcttcatctttgcctttcggtgccgcgcggcgctttatctcgtccccgtggcagcactgcttctcttcaaccgcttccggcgccgcgccgcggccgcggacatcgggctagtggacttttcgtgcctgaagccgccccgccggctgcgcatcccggtggcggggctgctcgagcacttcagcctcatcggctgcttcgacgacggcagcgtcgagttcatgaccaaggtcatcgaggccagcggcatgggcaacgagacctactttccgccatcgctgcactacatcccgccggcggcgacgcacgccgacgccatccaggaggcgcacatgctcttcttccccacgctcgacgacctcttcgccaagaccggcgtcccgccgtcggccgtcggcgcgctcgtcgtcaactgcagcgggttctgcccggccccgtcgctcgccgccatcatcgcaagccgctaccgcttgcgcgccgacgccaagaccttcaacctctccggcatgggctgcgcctcaggcgtcatcggcgtggacgtcgcgaggaggctcctgctcacgcacgccaccatctcgtacgccgtcgtcgtcagcgccgagatcgtcaccgtcgggtggtacagcggcaaggaccagggcaagctgctcctcaactgctacttccgcacgggctgctccgccgcgctcgtcaccaacagccgcggccccgcggcgacggtgccggtcaagtaccggctcgcgagcctgacgcgcacgaaccagatcgccaacgaccggagctaccgctcgggctatcgcgacgaggacggcgagggcatcaccggcttcaccctcggccagggcgtcggccgcatggtgagcgagctgctgcgcgcgcatctcgtgacgctcagcctgtccatcctcccattgcgcgagaagctgcgctacgtgctagcgctgctcctctcgtcccgccggcgcctaggcgacaacaagctctcccgccccgccgtgccgctgcctgacttctgcaaggccgcggaccacttctgcctcccgtcgtcgggcagaccgatgatctggcgcctgggccagggcctcgggctcggcgagcgagagatggaggcggcgctgatgacgttccaccggttcggcaaccagtcggcggcgtcgctgtggtaccagctcgcgtacctcgaggccaagggtcgagtccacgcgggcgacacggtgtggcagcttggcataggcagcggcctcaaggccaacagcatggtgtgggagcgcgtcgccggccacgaggaggagcgcgagctggggccatggaaggattgcatccacaagtaccctgtgacagatacctaagagcactgcgacttggttgcttgatgcggtgatcatccgtcagcattccaactggtaactggatcaattgatgttcttgaaaaagaaaacacttcatgtccgtacgctatggcatgaagagccgtttggtttccaatactacgttttaggcttcaaaaaaaaaaaaaaaaa

SEQ ID NO: 96510 - protein, 477 aa, Zea mays
  misc_feature: Ceres CLONE 1680828
  misc_feature (52)..(351): Pfam Name: FAE1_CUT1_RppA Pfam Description: FAE1/Type III polyketide synthase-like protein
  misc_feature (367)..(452): Pfam Name: ACP_syn_III_C Pfam Description: 3-Oxoacyl-[acyl-carrier-protein (ACP)] synthase III C terminal
  misc_feature: SWISSPROT Homolog: EC 2.3.1.119 Icosanoyl-CoA synthase
MDIAHRDYLLVKLHTCLGVATLLLCVLAELFIFAFRCRAALYLVPVAALLLFNRFRRRAAAADIGLVDFSCLKPPRRLRIPVAGLLEHFSLIGCFDDGSVEFMTKVIEASGMGNETYFPPSLHYIPPAATHADAIQEAHMLFFPTLDDLFAKTGVPPSAVGALVVNCSGFCPAPSLAAIIASRYRLRADAKTFNLSGMGCASGVIGVDVARRLLLTHATISYAVVVSAEIVTVGWYSGKDQGKLLLNCYFRTGCSAALVTNSRGPAATVPVKYRLASLTRTNQIANDRSYRSGYRDEDGEGITGFTLGQGVGRMVSELLRAHLVTLSLSILPLREKLRYVLALLLSSRRRLGDNKLSRPAVPLPDFCKAADHFCLPSSGRPMIWRLGQGLGLGEREMEAALMTFHRFGNQSAASLWYQLAYLEAKGRVHAGDTVWQLGIGSGLKANSMVWERVAGHEEERELGPWKDCIHKYPVTDT

SEQ ID NO: 96511 - DNA, 1365 bp, Zea mays
  misc_feature: Ceres CLONE 1681422
  misc_feature: Encodes the peptide sequence at SEQ ID NO. 96512
agaatcctcctctcagtcacagacacactcgttcgctcgctctcactctctgttgttcgtccatccatccggatccgtcttcctcggtctcccacgagcagcgaggaggctacagctgggaccggccaatggggaacaaaccgccggagctgtactacgacatcctccacgttgccagggacgcctccccgcagcgggtcagggcggcgtacaggagcctggtccgccaatggcaccccgacaagcaccctccggagtccaggccagcggcggaggcccggttcaaggccatcaccgaggcttacgaggcgctgctgggccagcaggggaacatgtcggcggcgcccgcagtcgcagcgcgcgacggcgaaaggagtagccccgccgacaaggaccgcgccgactccgcggcggtgtcagccaggcccagggcggcgcggagcggaaaggccggcggcgcgccctgcacgccggagcgggaggagccggccttcaagacggtggtgtacagcgccagcagcagcgtcggcggtggccggggccggcgcgcgctcgccgagttctccagctacgtggtgcgcaaggcgccgccgctggagcggagggtggagtgcaccctcgaggagctctgcagcgggtgccacaaggaggtcaggtacacccgcgacgtcgtcaccaagaacggactggtcaccaaggaggaggcgacgcggacggtccgggtgaagcccgggatgaggaaaggcgcgacggtgacgctggagggcgccggcgacgagcggccgggctgcctgacgggcgacgccacgttcgtcgtatccgagaggaggcaccggcggttcaagcggctcggcgacgacctggtgctcagggcccgggtgccgctggtcggcgcgctcacggggtggcagctctcgttcaggctgctcggcggcgacaggttccggtgcgcgttccgggacgaggtcatctgccccgggtacgtcaaggtcgtcaggggcggcggcatgcccgtcgccggcggggccaagggcgcgcgcggggacctcgtggtcaagttcgacgtcgtgttccccgaggacctcacggacgagcagcggaaggggctcgccgagattctgaggggctgcggatgaagcttgcaggtcaactcaaactgcggcctcgtcctgtgacggcttcgtgccgtgtaaaaatttttgttaggcgcttctgttgatagacagctcgggacaggaggactctacagcgcacgctgacagcgtgtacatagattacagaggttctgtttttgaaccgataatatacgtggttgtaacctgcaagaactgtatacggcgattttttgcaaaaaaaaaaaaaaaa

SEQ ID NO: 96512 - protein, 335 aa, Zea mays
  misc_feature: Ceres CLONE 1681422
  misc_feature (8)..(68): Pfam Name: DnaJ Pfam Description: DnaJ domain
  misc_feature (207)..(331): Pfam Name: DnaJ_C Pfam Description: DnaJ C terminal region
MGNKPPELYYDILHVARDASPQRVRAAYRSLVRQWHPDKHPPESRPAAEARFKAITEAYEALLGQQGNMSAAPAVAARDGERSSPADKDRADSAAVSARPRAARSGKAGGAPCTPEREEPAFKTVVYSASSSVGGGRGRRALAEFSSYVVRKAPPLERRVECTLEELCSGCHKEVRYTRDVVTKNGLVTKEEATRTVRVKPGMRKGATVTLEGAGDERPGCLTGDATFVVSERRHRRFKRLGDDLVLRARVPLVGALTGWQLSFRLLGGDRFRCAFRDEVICPGYVKVVRGGGMPVAGGAKGARGDLVVKFDVVFPEDLTDEQRKGLAEILRGCG

SEQ ID NO: 96513 - DNA, 1342 bp, Zea mays
  misc_feature: Ceres CLONE 1681897
  misc_feature: Encodes the peptide sequence at SEQ ID NO. 96514
aaaacgagcttctcttgtcactcatcagcacggttagtatagctagccaccatgaaggtagagcgcgatctccacatgagccggggcgacggcgaggacagctacgcctccaactcaaggcttcaggagaagtccatactgaagacgaggccggtgctgcacaaggccgtggcggcggcgcacgccttgtcgctctcctcaggaggacccggcggcggcgccatggtcgtcgcggacctcggctgctcgtcggggcccaacacactgctcgtcgtctcggaggtgctagcagcggtggcgatggtggccggcggcagcgcccaaccgcagcacgtgcagttcttcctgaacgacctccccgggaacgactttaacctcgtcttccggtcgctggacctgttgaagaacaagaagctggccgccaaggacaggcgggaggagtcgctgctaccgccgtactacgtggccgggctgccgggctccttctacacccggctgttcccggaccactgcgtccacctcttccactcctcctactgcctcatgtggcgctccaaggtccccgacgagctcgccggtggcgcggtcctcaacgagggccacatgtacatctgggaaaccacgccgcaggcggtggtggccctgtacaggaggcagttccaggaggacatgtcgctgttcctcaggcttcgccacagggagctcgtgcccggtggccacatggtgctggcgttcctgggcaggaagaagagcaaggacgtgcttcgtggcgaggtcagctacacgtgggggctcctcgcgcaggctctccagtccctcgtcaaacagggccgtgtgaagaaggataagctggactccttcaacctgccgttctacgcaccttcgatggacgaggtgagggacgtgatcacgcggagccaggcgttcgacatcacccacatccagctcttcgagtccaactgggatccacacgacgacgacgacgtggagatgaagatggaagaagacgtcgccgccgtccagagcggcgtcaacgtcgccaggtccatcagggccgtgatcgggcccctcatcgcccgccactttggcgagcacatactcgacgatctcttcgagctgcatgccaaaaatgtcgcagtgcacctgcagaaagtgaagaccaagtaccctgtcatcgtcgtttccctccaggcgaaatgagccgcgcgccaaataaaggaccaagctagctgatgcaaaatctggcgtcaagttagctattagtaccgctactattatatgcatgcagaataattagtcaaacaatcagaaaaataaagtgcctcaaaaaaaaaaaaaaaaa

SEQ ID NO: 96514 - protein, 382 aa, Zea mays
  misc_feature: Ceres CLONE 1681897
  misc_feature (36)..(382): Pfam Name: Methyltransf_7 Pfam Description: SAM dependent carboxyl methyltransferase
  misc_feature: SWISSPROT Homolog: EC 2.1.1.141 Jasmonate O-methyltransferase
MKVERDLHMSRGDGEDSYASNSRLQEKSILKTRPVLHKAVAAAHALSLSSGGPGGGAMVVADLGCSSGPNTLLVVSEVLAAVAMVAGGSAQPQHVQFFLNDLPGNDFNLVFRSLDLLKNKKLAAKDRREESLLPPYYVAGLPGSFYTRLFPDHCVHLFHSSYCLMWRSKVPDELAGGAVLNEGHMYIWETTPQAVVALYRRQFQEDMSLFLRLRHRELVPGGHMVLAFLGRKKSKDVLRGEVSYTWGLLAQALQSLVKQGRVKKDKLDSFNLPFYAPSMDEVRDVITRSQAFDITHIQLFESNWDPHDDDDVEMKMEEDVAAVQSGVNVARSIRAVIGPLIARHFGEHILDDLFELHAKNVAVHLQKVKTKYPVIVVSLQAK

SEQ ID NO: 96515 - DNA, 1328 bp, Zea mays
  misc_feature: Ceres CLONE 1681933
  misc_feature: Encodes the peptide sequence at SEQ ID NO. 96516
actgttccgcagaatccgagtccaatagctctcctccccagggctttcaacttctccaaaccccatctcgccgccgaggccgagcgagcagagcagaacaccacgtcggcggcttttccctgtctctccgctggatactacacccgccgccgcagcgccgatcctgtccgagtcaagcggagcgggggatcggattggttgcttccttccctccatctcatgttggtggactgagagatggagttttaatttcaaatagcatctagaggactgccactaagcttttaagttggtatataatgggtggctgttgttgctgttcgtcgagaacatctgaagcagttagagcacgagcaccagttgatatatatcatcaacaaaatcttgaggagcaggagccattgtcttcaatttttgatggatcatctccagcctctgcaattgttgcagtagacacaaatctggatacttccacacctgacacatatcgagcgccgcctgcacccttgccttatgatgttattttggcagtcccaaataaccctggtttggagaagccagacactaagagcaaaactgatgaccaacaagagtccataaatgatcaggagtctttaaaggtggatgagtcatgtaagaaaagtgtcactgaagataaggctgatgaggaggatgtttgccctatctgccttgaagaatatgatgaagaaaatccccgttctataactaaatgcgagcatcatttccatctttgctgcattctcgaatggatggagcgaaaagatacttgcccagtttgtgaccagattactttggtggatgagatgttcgaataggtttggtaaccttggtggatcatcactcgaagctgttcgttactgagaaagtgcagcaactaatttacttttgatattgatccattccgggtggctcgcatggtaatgaattgagggggcaaaaattgaaaggatgaatgtcatgaaatgtatttacaacgcctcctttgtcatgcgttgtgtcatgctatatatatgccggcttgcgggttcattcagttcaaagtccaggactatccttttgcttttctgaattcagagtttcagacatctgctggttcttccaggttccggtcagctgtgtatatcatatattaggtggttgcaggtaaaaatggtctagagggtgggggttgctttgtacaatccacatggtatttaagcttcatgtatataatcttttctgtttctcttcgttttgttctgctgaatacttgcagatccttactgttctgataaaacttactgactccctaaaaaaaaaaaaaaaaa

SEQ ID NO: 96516 - protein, 178 aa, Zea mays
  misc_feature: Ceres CLONE 1681933
  misc_feature (127)..(167): Pfam Name: zf-C3HC4 Pfam Description: Zinc finger, C3HC4 type (RING finger)
MGGCCCCSSRTSEAVRARAPVDIYHQQNLEEQEPLSSIFDGSSPASAIVAVDTNLDTSTPDTYRAPPAPLPYDVILAVPNNPGLEKPDTKSKTDDQQESINDQESLKVDESCKKSVTEDKADEEDVCPICLEEYDEENPRSITKCEHHFHLCCILEWMERKDTCPVCDQITLVDEMFE

SEQ ID NO: 96517 - DNA, 686 bp, Zea mays
  misc_feature: Ceres CLONE 1682056
  misc_feature: Encodes the peptide sequence at SEQ ID NO. 96518
aagggagtggcctggcagagaatcgactcgaatcgactcgacaatggcgaagctgcacaggctcatctccgccgtcctcaggctggccgcggcgggagccgcggccgccgcagccgtgatcatggtgactagccacgagaccaccagcttgttcggcatagagatggaagccaagtactcctacactccatcattcgtcttcttcgtggtggctttcgctgtgaccttcgcctacagcctgctcgcggccgtcctcgtgcgcccggggaccaccgcctccagattagtgctcctaagcgacgtgacggtagggatgcttctgacgggcgccgtggcggccaccggcgccatctctcaggtggggaagagcggcaacgagcacgccgggtggctgcccatctgcgcgcaggtgcaggcctactgcggccacgtgatgggggcgctcatcgccggcttcgtctcgctgctcctctacttcctcatcatcatgtactccctccacgcggtcgccgaacccctgtgctcctgccattagaacacggccaaacgcgcacactattcgttcgattatattcactaggtcatcgacgatgatccaatggtcggtccccagtgatacgttgttttccgtctcactactatatatatctctgccgcactgttgagtcgaaaaaaaaaaaaaaaaa

SEQ ID NO: 96518 - protein, 163 aa, Zea mays
  misc_feature: Ceres CLONE 1682056
  misc_feature (2)..(143): Pfam Name: DUF588 Pfam Description: Domain of unknown function (DUF588)
MAKLHRLISAVLRLAAAGAAAAAAVIMVTSHETTSLFGIEMEAKYSYTPSFVFFVVAFAVTFAYSLLAAVLVRPGTTASRLVLLSDVTVGMLLTGAVAATGAISQVGKSGNEHAGWLPICAQVQAYCGHVMGALIAGFVSLLLYFLIIMYSLHAVAEPLCSCH

SEQ ID NO: 96519 - DNA, 1396 bp, Zea mays
  misc_feature: Ceres CLONE 1682229
  misc_feature: Encodes the peptide sequence at SEQ ID NO. 96520
aacaaacaaaccgcaaagcaagcacacgagaaaaaaaaaatcacaatgagctcatgggttaccaagtcgctgccttttctcgtggctccggcagtggcctcgcccactgccgccctccagctcacctccatggacagagctctggtttccctgcccgtgtcagcgatgttcgtctacgagaaccccatcgatcgtccggccgagaccattagaagagctctgtcccgtgcgcttgttccctactacccaatggccggccgcctcgccgtcactggggaccagctgaagctcgcgtgcaccggcgagggcgtagcgttcgtcggtgcgtcggcgagctgcaccctgcaggacgccaggctctgcgaccggcgtcccgtggtcagtgtcgaggacctcagtatcagctatgccggccagtacagcgaggaccctccacttctgctggtgcaggtgaccgagttttcctgtggcggcttcgttgtcggggtgacgtggaaccacgtcctcacggacggcgccggcatggcgcagttcttgaaggccgtcggcgagtttgcccgaggttccccttccccttccgtcttgccgatgagggtggacgacaccctctctgaactccccccgccaataaccaccatgactaaggcactcgtcagcagcaagcccagagacatgccgtcctcctacatcacagttcccctgagcttcgtcgaccgcatcaagggcgagttccgtcgtcgcagctacggcagcggcagcggccaggtgtcgacgtgcactgcgttcgacgtgttcaccgccgccatatggaagtgccgtgcccgcgcgacgatcggcagcgccgccagcccggacgcccccacggcgctcgccttcacggtgaacgtgaggaagccggccaaggccaaggacggctactacggcaacgtcttcgccttcggcctcgctgcctcgacgctgcgcgaggtcgcggacggcgacatcctggaccttgtgacgctggtcagggacgccaaggcacgggtcccgttcacgttcgctgacggagccgcgcacatcgccgacgagatgggcggtcggctcaagggcctcgacggctacgacaccctgtacgtcacgagctggtggaacctcggcttggacgacgttgacttcggcagcggcggcgctgagcgcgtcatcgggtgcatggagcgcaaggtggtgccgggctgcttcctgtgcgggaaaaaggacaaggccgagggcgtcgccgccatggcgctctgcgtcaagcaggagcacgctgaggctttccatgcggagctacgaagcctcaagtgacgcggagaccttacatgtttgtccgtgtttcaattttaataagagcactttaaactaaaaaaaaaaaaaaaaa

SEQ ID NO: 96520 - protein, 425 aa, Zea mays
  misc_feature: Ceres CLONE 1682229
  misc_feature (3)..(424): Pfam Name: Transferase Pfam Description: Transferase family
  misc_feature: SWISSPROT Homolog: EC 2.3.1.167 10-deacetylbaccatin III 10-O-acetyltransferase
MSSWVTKSLPFLVAPAVASPTAALQLTSMDRALVSLPVSAMFVYENPIDRPAETIRRALSRALVPYYPMAGRLAVTGDQLKLACTGEGVAFVGASASCTLQDARLCDRRPVVSVEDLSISYAGQYSEDPPLLLVQVTEFSCGGFVVGVTWNHVLTDGAGMAQFLKAVGEFARGSPSPSVLPMRVDDTLSELPPPITTMTKALVSSKPRDMPSSYITVPLSFVDRIKGEFRRRSYGSGSGQVSTCTAFDVFTAAIWKCRARATIGSAASPDAPTALAFTVNVRKPAKAKDGYYGNVFAFGLAASTLREVADGDILDLVTLVRDAKARVPFTFADGAAHIADEMGGRLKGLDGYDTLYVTSWWNLGLDDVDFGSGGAERVIGCMERKVVPGCFLCGKKDKAEGVAAMALCVKQEHAEAFHAELRSLK

SEQ ID NO: 96521 - DNA, 1235 bp, Zea mays
  misc_feature: Ceres CLONE 1682366
  misc_feature: Encodes the peptide sequence at SEQ ID NO. 96522
aaaacacgaaacccagatccacgcccactgtcctctgcccaaggctacggtaccacaccacaaccacactcggtgagtgaggtagcggcacgagcacgcgccatgaagagccccgccgttccggccaagaggcgccacggcggcaacggcagcggcagcggcccggggttcgcgcttgggtgcggctgcaaggacgccaagagcgtgtcggtgtccgtgtccgcgtccgcgtccccgtcccagtcggcgacgacagggacgtcgaccgtgacgcgccgcacgagcgccggcgggctgaacccgtgggcgtcgacgacgacggacaccctgacgtcggcgtcggcgtcctcgctctgggaagacgcggtggaggggctgggctacaaggacggcggctgccggatggtgccggagagcaccgcgccgagcttctccagcctgctgcgcgagctcggcgagctggagcggagcgtcgcgtcgtggggcggcgcgcggaagggacaccgccgcgaccgcgagggcaagctctcgccgccggcgctgcggcacgagcagcagaggagggcggccaagggcgagcccagggactcggaggagaaccgcttcgtcgacgcgggcgcggggctccagggcagcgtggcggtggtgaagcagtcggacgacccgctccgcgacttccggcgctcgatgctgcagatgatcgtggagaacgggatcgtggcgggcgaggacctgcgcgagatgctccggcgcttcctcaccctcaacgcgccgcaccaccacgacgccatcctgcgcgccttcgccgagatctgggacgacgtgttcgtcgccgccgccgcgtcgctcgacgactgtgccagcccggtcggccgagcgtcctccgtctcaggccgggaaccggcggcggcgggcaggccgccagcgcccagaacgaccgcccgccaccaccgccgctcgccaccggcgtggcgcgtgtagtgggtagtaagggtaactcgtcgtacgcgtgcgttgtctttctcatttgctaccccggggtggcaatgtacgtgcgtgcgtgcgctgctgaaaaggcaaatactatacactaccgtatcagttcattcgtgttccatttccgcgtactggaaaaggcacgagaatgtggtattgccttcttcttttttaaaaaaaaaaaaaaaaaaaaaaaaaaaaaaaaaaaaaaaaaaaaaaaaataaaaaaaaaaaaaaaa

SEQ ID NO: 96522 - protein, 292 aa, Zea mays
  misc_feature: Ceres CLONE 1682366
  misc_feature (185)..(244): Pfam Name: DUF623 Pfam Description: Protein of unknown function, DUF623
MKSPAVPAKRRHGGNGSGSGPGFALGCGCKDAKSVSVSVSASASPSQSATTGTSTVTRRTSAGGLNPWASTTTDTLTSASASSLWEDAVEGLGYKDGGCRMVPESTAPSFSSLLRELGELERSVASWGGARKGHRRDREGKLSPPALRHEQQRRAAKGEPRDSEENRFVDAGAGLQGSVAVVKQSDDPLRDFRRSMLQMIVENGIVAGEDLREMLRRFLTLNAPHHHDAILRAFAEIWDDVFVAAAASLDDCASPVGRASSVSGREPAAAGRPPAPRTTARHHRRSPPAWRV

SEQ ID NO: 96523 - DNA, 1379 bp, Zea mays
  misc_feature: Ceres CLONE 1682434
  misc_feature: Encodes the peptide sequence at SEQ ID NO. 96524
aaagcgtagacctaccacggcgctgggccaaccagtcccgatcgatcagccatggcgtcctcctccaaacggtcgctgccatgcgtgctcctcctcctcgctctcttccaccacggctgctcgtcggcgagggcccacagacgcgccggcgacacgatggggagcatgagcaacgacgacagctcgatgatagagcggttccagcggtggaaggcggcgtacaacaagtcctacgccacggtcgccgaggagcggcggcggttccgggtgtacgcgcgcaacatggcgtacatcgaggccaccaacgccgaggccgaggcggcggggctcacgtacgagctcggcgagacggcctacaccgacctcaccaaccaggagttcatggccatgtacacggcgcccgcgctggcgcagctgcccgcggacgagtcggtgatcaccacgcgcgctgggccggttgacgccgtcgggggcgcgccgggccagctgccggtgtacgtgaacctgtccgcctccgcgccagcgagcgtggactggcgagccagcggcgccgtgacgccggtgaagaaccaaggccgatgtgggtcgtgctgggccttctcgacggtggcggtggtcgaaggcatctaccagatccggacagggaagctggtgtccctgtcggagcaggagctggtggactgcgacacgctggacgacggctgcgacggcggcatcagctaccgcgcgctgcggtggatcgcctccaacggcggcatcaccacggaggccgactacccgtacacgggcaccacggacgcctgcaacagggccaagctctcccacaacgcggtcagcatcgccgggctccggcgcgtggccacccggagcgaggcgtcgctggccaacgccgtggcggggcagcccgtggccgtgtccatcgaggccggcggcgacaacttccagcactacaagaagggagtgtacaacgggccctgcgggaccaacctcaaccacggcgtcaccgtcgtcggctacggccaggaggcggccgccggcgacaggtactggatcgtcaagaactcgtgggggcaggggtggggcgacgacggatacatcaggatgaagaaagacgtcgccggcaagccggaggggctctgcggcatcgccatccgcccgtcctatccactaatgtgacatggtgtggtgtacatctgttttcgttttaattatcattttattttattaaacaataaataaatagtcaacatatggatcgactcaaacttttgcagttacgtgtaccagtacacttgttgtaaataataatccatggcatctcgcgtgtaaactttattctggtgcattgtatatcccagaacaaaaaaaaaaaaaaaaaa

SEQ ID NO: 96524 - protein, 374 aa, Zea mays
  misc_feature: Ceres CLONE 1682434
  misc_feature (156)..(373): Pfam Name: Peptidase_C1 Pfam Description: Papain family cysteine protease
  misc_feature (50)..(110): Pfam Name: Inhibitor_I29 Pfam Description: Cathepsin propeptide inhibitor domain (I29)
  misc_feature: SWISSPROT Homolog: EC 3.4.22.33 Fruit bromelain
MASSSKRSLPCVLLLLALFHHGCSSARAHRRAGDTMGSMSNDDSSMIERFQRWKAAYNKSYATVAEERRRFRVYARNMAYIEATNAEAEAAGLTYELGETAYTDLTNQEFMAMYTAPALAQLPADESVITTRAGPVDAVGGAPGQLPVYVNLSASAPASVDWRASGAVTPVKNQGRCGSCWAFSTVAVVEGIYQIRTGKLVSLSEQELVDCDTLDDGCDGGISYRALRWIASNGGITTEADYPYTGTTDACNRAKLSHNAVSIAGLRRVATRSEASLANAVAGQPVAVSIEAGGDNFQHYKKGVYNGPCGTNLNHGVTVVGYGQEAAAGDRYWIVKNSWGQGWGDDGYIRMKKDVAGKPEGLCGIAIRPSYPLM

SEQ ID NO: 96525 - DNA, 1287 bp, Zea mays
  misc_feature: Ceres CLONE 1682533
  misc_feature: Encodes the peptide sequence at SEQ ID NO. 96526
agacaatcccagcccgtcccgcggcatcccaaaggtccaaatcattctccgaggagctgcggcgctgcggcgacggcggcagcgacggcgatgcggttgccatctgccgcctcggcgtcccgccttccctcttcccttttcttacaaccccgcgcaaggacaagatgcgtcccatcctcctccctcgcctgtcgggcatcttcttcatcagccgcgggcgctggtgacggcggctcgcggaagccgtggctcttcgtagggctgggtaaccccggaaaggtgtaccagggaactcgccacaacgttggattcgagatgatcgatgttatagcagaagctgagggtatatctctgagcagtatgcagttcaaggcaatggttggaaaaggccgcattggtgatgcatctattatgcttgccaagccacaaacctttatgaatgcaagcggtgagtctgtcgggcagctggtttcatatttcaagataccacttagtcaagtcgttgtgatgtatgatgatctggatttaccctttgcaaaactgcgtctgctgccaaagggtggccatggtgggcataatgggatgagaagcatcgtcaaccatttgaaacagagccgtgattttccacgcctaagaattggcattggacgaccgcccgggaagatggatcctgccaatttcgttctccggccttttaacaagaaagagcagcaagagcttgattttgcgttgcataggggcttggaggcggtgcggataatggtgccggaaggattcaacaagagcgcgacttacgtgaacactgcacaatcatctgaaatgctgaataggtgatgggccaataaactgccatatgcgatttaaatcccataccaaagggatttaatcgaggaagcagtcgcagcttcgcttgatgcatcgtttgttcggtggccatcccccctctcctggcaagaaagttctgacagctgaattacttgttagatcatactgtatgatctgagcaacttagggggtgtttggtttgagaaatcattccatctaagatgagatggtgcatcacgaatcaattcctcaaatttggtggaatgacctcattcctcatgttattactaactaattaactataaagaatgaggtggtgattgatcaactcattccattatacaaactaaacaaaaaagtgaggaataagtgatggtggactagtttattcctcaaaaaaaaaaaaaaaaaaaaaaaaaaaaaaaaaaaaaaaaaaaaaaaaaaaaaaaaaaaaaaaaaaaa

SEQ ID NO: 96526 - protein, 247 aa, Zea mays
  misc_feature: Ceres CLONE 1682533
  misc_feature (54)..(237): Pfam Name: Pept_tRNA_hydro Pfam Description: Peptidyl-tRNA hydrolase
  misc_feature: SWISSPROT Homolog: EC 3.1.1.29 Aminoacyl-tRNA hydrolase
MRLPSAASASRLPSSLFLQPRARTRCVPSSSLACRASSSSAAGAGDGGSRKPWLFVGLGNPGKVYQGTRHNVGFEMIDVIAEAEGISLSSMQFKAMVGKGRIGDASIMLAKPQTFMNASGESVGQLVSYFKIPLSQVVVMYDDLDLPFAKLRLLPKGGHGGHNGMRSIVNHLKQSRDFPRLRIGIGRPPGKMDPANFVLRPFNKKEQQELDFALHRGLEAVRIMVPEGFNKSATYVNTAQSSEMLNR

SEQ ID NO: 96527 - DNA, 1328 bp, Zea mays
  misc_feature: Ceres CLONE 1682540
  misc_feature: Encodes the peptide sequence at SEQ ID NO. 96528
acttccccgggcgtcgaacaaccgactcagaactggtacggacaaggggaatccgactctttaattaaaacaaagcattgcgacggtcctcgaggatgctgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagtttcccactgtccctgtctactatccagcgaaaccacagccaagggaacgggcttggcggaatcagcggggaaagaagaccctgttgagcttgactctagtccgactttgtgaaatgacttgagaggtgtaggataagtgggagcctccgggcgcaagtgaaataccactacttttaacgttattttacttattccgtgggtcggaagcggggcaccgcccctccttttggctccaaggcccggcctcgccgggccgatccgggcggaagacattgtcaggtggggagtttggctggggcggcacatctgttaaaagataacgcaggtgtcctaagatgagctcaacgagaacagaaatctcgtgtggaacaaaagggtaaaagctcgtttgattctgatttccagtacgaatacgaaccgtgaaagcgtggcctatcgatcctttagaccttcggagtttgaagctagaggtgtcagaaaagttaccacagggataactggcttgtggcagccaagcgttcatagcgacgttgctttttgatccttcgatgtcggctcttcctatcattgtgaagcagaattcaccaagtgttggattgttcacccaccaatagggaacgtgagctgggtttagaccgtcgtgagacaggttagttttaccctactgatgaccgcgccgcgatagtaattcaacctagtacgagaggaaccgttgattcacacaattggtcatcgcgcttggttgaaaagccagtggcgcgaagctaccgtgtgccggattatgactgaacgcctctaagtcagaatccaagctagcaaccggcgcctctgctcgccgcccgccccgacccacgttagggcgttcgcgccccaagggcccgtgccattggctcagcccgcccggccgacgcgccgcggcgggccgcctcgaagctcccttcccaacgggcggcgtgctgaatcctttgcagacgacttaaaacgcgacggggcattgtaagtggcagagtggccttgctgccacgatccactgagatccagccccgcgtcgcacggattcgaaaaaaaaaaaaaaaaa

SEQ ID NO: 96528 - protein, 55 aa, Zea mays
  misc_feature: Ceres CLONE 1682540
MPRHLISDAHEWINEFPTVPVYYPAKPQPRERAWRNQRGKKTLLSLTLVRLCEMT

SEQ ID NO: 96529 - DNA, 1673 bp, Zea mays
  misc_feature: Ceres CLONE 1682590
  misc_feature: Encodes the peptide sequence at SEQ ID NO. 96530
aatggcatgggcgcatggccacgcctccggccgccgtctgtgccctcaccgctgccgcatccaccgggcgccacctccggcagatccacgcccacctcgtcacctccggacacctctcttccctcggacccaccctcctgcaccggctcatttcgctgcacccgccgcatctccaacttgcttacgctcaccgccttctcctctccatcccatccccgccgctcgacctcttcaacctcctactgccgccgctcgcctcctcgcccgatcccgccgccgcggccggactctacatccacctccgccgccggggccttggcccggatgcccacacgctcccgcacgtcctcaaggcgctcgcgcgcctcggtccaggatgcctcccgctcgtcgcctgcacccacgcggaggccgtcaagaccggccttgcgcgcgccgtggtgtacgtgccgaacgccctcatgtctgcgtactctgcctgcggccacctccatcgcgccatgcaggtgttcgacgaaatgccgcgttggaccgttgtgtcatggaacaccgtgctcactgcctgcgcggacaacggccgccacgactggtgcgccgggatgttcgtgaacatgttagaggctgggtctgtgcccaatcagacgacgttcgtggtcatgctcaccgctgcggctgagctggggaacttggcgcttggcaagtgggcgcatgggcaggtccttacccgacgtattgacatgacgcttcagcttggcacggctgtggtgaatatgtacaccaagtgcggcgaggtgagttatgcatcgtgcttgtttgagaatatggcagcacggaacgtctggacatggagcgcgatgatcatggggtattcacagaacgggatggtacgagaagcactggagcttttcgacaggatgaaggatgcatcagttgcgcccaactatgtcacatttcttggactcctctgcggatgcagccatgctggtctggtcaacgagggccgcaaattcttccatgaaatggagcatgtctatggcatcaagccaatgatgacccactacagtgccatggttgatgtcctggggcgcaacggcctcctccaggaagcttttgagtttgtcgtggacatgccggtcgaggctgacacggtcgtttggaggacgttgctgagcgcctgccaactgcacagctccaaggactgcattggcatcgttgataaggtgcagaagaggttgctggagttggagccccgcagaagtgggaaccatgtgatggtcgcgaacatctactctgacattgggttgtgggacaaggcggccatggcgaggagggtgatgagggaaggagggatgaagaagatggcgggggagagctgcgtcgaggtaggagggcggattcgccgattcatctctggggatgaatcctgtcctgggttgggtggggtttacagggttcttcatgagttgaacatcaacatgagaaaatgggaacctgtggacaaaattttgcttgctgattctgacctgtgagtaccatgtacggtggccaaaactgtttatactgttcatgtcagtcctcttgttctccatattagcctgcaaaagcttagtaattttactcttgtagacatgatagcacatttgatcatctatcatttttcataaaaaaaaaaa

SEQ ID NO: 96530 - protein, 504 aa, Zea mays
  misc_feature: Ceres CLONE 1682590
  misc_feature (276)..(310): Pfam Name: PPR Pfam Description: PPR repeat
  misc_feature (175)..(209): Pfam Name: PPR Pfam Description: PPR repeat
MATPPAAVCALTAAASTGRHLRQIHAHLVTSGHLSSLGPTLLHRLISLHPPHLQLAYAHRLLLSIPSPPLDLFNLLLPPLASSPDPAAAAGLYIHLRRRGLGPDAHTLPHVLKALARLGPGCLPLVACTHAEAVKTGLARAVVYVPNALMSAYSACGHLHRAMQVFDEMPRWTVVSWNTVLTACADNGRHDWCAGMFVNMLEAGSVPNQTTFVVMLTAAAELGNLALGKWAHGQVLTRRIDMTLQLGTAVVNMYTKCGEVSYASCLFENMAARNVWTWSAMIMGYSQNGMVREALELFDRMKDASVAPNYVTFLGLLCGCSHAGLVNEGRKFFHEMEHVYGIKPMMTHYSAMVDVLGRNGLLQEAFEFVVDMPVEADTVVWRTLLSACQLHSSKDCIGIVDKVQKRLLELEPRRSGNHVMVANIYSDIGLWDKAAMARRVMREGGMKKMAGESCVEVGGRIRRFISGDESCPGLGGVYRVLHELNINMRKWEPVDKILLADSDL

SEQ ID NO: 96531 - DNA, 1588 bp, Zea mays
  misc_feature: Ceres CLONE 1682692
  misc_feature: Encodes the peptide sequence at SEQ ID NO. 96532
acccgacctcgccaccgccacaaacgctgtccagctcctcgcactctgacactccctcaatctccctccttcccgtccacgtcgctcgccgttccgcctcccgcattccgtccaacacccccgccgccactaccatggcgaccatcctcctatcctcccgcctcccaaccaccggtacagccacgccgtcgcccacccgccccgctccgcggttcctctccttccccgggaccgccatccgacgccgcggccggggcccgctcctcgcctcctccgcggtctcaccgcccgcgccggcttcggcggcgcagccctaccgcgcgctgccggcctcggagaccacggtcctcgtcacgggcgccacgggctacatcggccgctacgtcgtctgggagctcctccgccggggccaccgcgtgctcgccgtggcgcggtcccggagcggcatccgcggccgcaactcccccgatgatgtcgtcgcggacctcgcccccgcccaggtcgtcttctccgacgtcaccgacccggccgcgctgctcgcggacctcgccccgcacgggcccgtccacgccgcggtctgctgccttgccagccgcggcggcggcgtgcaggactcgtggcgcgtcgactaccgcgccacgctgcacacgctccaggccgcgcgcgggctcggggccgcccacttcgtgcttctctccgccatctgcgtccagaagccgctcctcgagttccaacgcgccaagctcaagttcgaggaggagctggccgcggaggccgcgcgggacccctccttcacctacagcgtcgtgcgccccacggcgttcttcaagagcctcggcggccaggtcgacatcgtcaagaacggccaaccgtacgtcatgttcggcgacggcaagctctgcgcttgcaagcccatcagcgaggaggacctcgccgccttcatcgccgactgcatatacgaccaggacaaggccaacaaggtgctgcccattggcgggccggggaaggcgctcacgccgctggagcagggggagatgctgtttcggctgctcgggcgcgagcccaagttcatcaaggtgcccatacagatcatggacgccgttatctgggtgctcgatggattggccaagctgttcccggggttggaggacgccgccgagttcggcaagattggcaggtactatgcctcggagagcatgctgttgctggacccggagaccggggagtacagcgacgagaagacgcccagctacggcaaggacacgctcgagcagttcttccaaagagtgataagggaagggatggcggggcaggagcttggcgagcagaccatcttctaggccttctccattaccagtttccgggagaaagaaacttgtagtagattatatgccgacaatgtacttgtagagatgtgagctttttgacttgctgatgatgtaaacacgactcgcgattcaatcataccaaagtatgatgattgtctaatttggaggaagagaaatgttttgacttgttgcttcaaagaagctgatatcttgtctgcacataatacatgttttcgcccacaataaaaaaaaaaaaaaaa

SEQ ID NO: 96532 - protein, 401 aa, Zea mays
  misc_feature: Ceres CLONE 1682692
  misc_feature (71)..(314): Pfam Name: NmrA Pfam Description: NmrA-like family
  misc_feature: SWISSPROT Homolog: EC 5.1.3.2 UDP-glucose 4-epimerase
MATILLSSRLPTTGTATPSPTRPAPRFLSFPGTAIRRRGRGPLLASSAVSPPAPASAAQPYRALPASETTVLVTGATGYIGRYVVWELLRRGHRVLAVARSRSGIRGRNSPDDVVADLAPAQVVFSDVTDPAALLADLAPHGPVHAAVCCLASRGGGVQDSWRVDYRATLHTLQAARGLGAAHFVLLSAICVQKPLLEFQRAKLKFEEELAAEAARDPSFTYSVVRPTAFFKSLGGQVDIVKNGQPYVMFGDGKLCACKPISEEDLAAFIADCIYDQDKANKVLPIGGPGKALTPLEQGEMLFRLLGREPKFIKVPIQIMDAVIWVLDGLAKLFPGLEDAAEFGKIGRYYASESMLLLDPETGEYSDEKTPSYGKDTLEQFFQRVIREGMAGQELGEQTIF

SEQ ID NO: 96533 - DNA, 1774 bp, Zea mays
  misc_feature: Ceres CLONE 1682845
  misc_feature: Encodes the peptide sequence at SEQ ID NO. 96534
aaaaaaaaaaaagtatatacttggcagttggcaccaaccatacgtgtgggcatatttcaccaaggctccgacgaccaccggtgaaagtgaaacgtcggtgtccggcgacgaccgagttcccatcgccggaaatcatggagaagcttccgtcacagcagcaggttgtgctgttggcgagtcctggcgcgggccacctcatcccgatggtggagctcgcgcagcggctcgccgctgaccacggcttcgcggtcacgttggtcaccatccccggcatgtccaacccggcaacggaggccgtcgtgctgtcctcgctgccgtcctacgtcctgaccgcggtgcttcctgctgttcctcttgacgacctcccgtcggacatcggcttcggtgccctcgtgttcgagttcgtccgccgatcgctcccaaacctccgcgcgctcatggaggacgccagccgcggctcggtgaccgcgctcgtatgtgacttcttcggaacctcggcgctgccgctcgccgcggagctcggcgttcaggggtacgtcttcttgccgaacagcttcgccatgatctccatcatgcgccacctcgcggggctccatggcgacgccgctgcccccggcgaataccgttacctcccggacctgctcccgctcccagctggaggcctggttcttcaccacgccgacctccccgaagggttccaggaccggaaagacccggtgtacgcctatcacgttgaggaggcccggagatacggccgcgccaacggcttcttggtgaacagcttcgaggagctggaggtcgtcatggtggaaacgttcaagcgggacgccgaggacggcgcgttccctccggtgtaccctgtgggaccctttgtcaggtcaagctccagcgaagaagccgatgaatcgggctgccttgagtggctggatcgccaaccggagaactcggtggtatacctctccttcggcaccgggggctcgctatccgtggagcagacggccgagctcgccgccgggctggagatgagcggccacaggtttctttgggtcgtgcgcatgccgagcctcgacggcaacccctgtgcctatgggtcgatgcccggcgacaaggacgacccactggcgtggctccccgagggattcttggagaggacgagcggccggggcctcgccgtcgtggcgtgggcgccgcaggtgcgcgtgctgtctcactcggcgacggcgtgcttcgtgtcgcactgcgggtggaactcgacgctggagagcgtggcagccggcgtgccgatggtcgcatggccactgtacgcggagcaaaagatgaacgcagccatcctgaccgaggtgaccggcgtggcgctgcggccggcggcgcgcggcaacggccacggcttggtcacgcgcgaagagatcgcggcttcagtgaaggagctaatggagggggagaaaggaagcgcggtgcgcggccggacgagagagctgcgtgaggcttcgaagcgtgcgtggtcgtcggaagggtcttcccggcgggcgctcggggaagtcgccggcaagctgaaggctgcacttgtcaacgggaacggatcggctccatgattcgttttcttcccgtgaatcggatgagataaaaaaaactattttttactgcaattcattgggtgtggtaattatggcatatgtatttatggactagctgtatctattcaaagttttttttgcttgcgtaaaaaaaaaaaaaaaaaaaaaaaaaaaaaaaaaaaaaaaaaaaaaaaaaaaaa

SEQ ID NO: 96534 - protein, 485 aa, Zea mays
  misc_feature: Ceres CLONE 1682845
  misc_feature (9)..(477): Pfam Name: UDPGT Pfam Description: UDP-glucoronosyl and UDP-glucosyl transferase
  misc_feature: SWISSPROT Homolog: EC 2.4.1.218 Hydroquinone glucosyltransferase
MEKLPSQQQVVLLASPGAGHLIPMVELAQRLAADHGFAVTLVTIPGMSNPATEAVVLSSLPSYVLTAVLPAVPLDDLPSDIGFGALVFEFVRRSLPNLRALMEDASRGSVTALVCDFFGTSALPLAAELGVQGYVFLPNSFAMISIMRHLAGLHGDAAAPGEYRYLPDLLPLPAGGLVLHHADLPEGFQDRKDPVYAYHVEEARRYGRANGFLVNSFEELEVVMVETFKRDAEDGAFPPVYPVGPFVRSSSSEEADESGCLEWLDRQPENSVVYLSFGTGGSLSVEQTAELAAGLEMSGHRFLWVVRMPSLDGNPCAYGSMPGDKDDPLAWLPEGFLERTSGRGLAVVAWAPQVRVLSHSATACFVSHCGWNSTLESVAAGVPMVAWPLYAEQKMNAAILTEVTGVALRPAARGNGHGLVTREEIAASVKELMEGEKGSAVRGRTRELREASKRAWSSEGSSRRALGEVAGKLKAALVNGNGSAP

SEQ ID NO: 96535 - DNA, 1361 bp, Zea mays
  misc_feature: Ceres CLONE 1682867
  misc_feature: Encodes the peptide sequence at SEQ ID NO. 96536
aaccaaacaacccctcggtctaagctcgcctctgcctcacagccgccttccgatcgagctaccagtgcgtagctcaaaactcaaaacgagaagcaagaactcagtagcaatatatggcgaagtcttgcaccttactgttcggcacagtactggtcgtgctcttgcttctagtgagccccattgcttgctcccgcaagctcgccaagccaacaaacaagcacaggccgagacacaagccggcggcagtcagagcccgcagcaaccacactgccaccccctcggtgtccgacgcctacggctccggcggatggttgtccgccggcgcgacgtactacggcgcacccgacggcgacggcagtgacggcggcgcgtgcggctaccagaccgccgtcgggcagcgtcccttctcgtcgatgatcgccgccggtagcccgtcgctgttcaaggagggcaagggatgcggcgcttgctacgaggttaaatgcgacagcaacgctgcatgctccggcaagccggcgaccgtggtcatcaccgacgagtgccccggtggcgtctgcctcgccgaggcggcccacttcgacatgagcggcacctccatgggcgccatggcgaagcccggcatggccgacaggcttcgcgcctctggtatcctaaaggttcagtacaagagggtcccgtgcaagtacagcggcgtgaacatcgccttccgggtggaccagggctccaacccgttctacttcgaggtgctggtcgagttcgaggacggcgacggcgacctcagcgccgtcgacctcatggaggccgggtgcggcacatggaccccgatggtgcagaactggggcgcgctgtggcgctacaactccaactccggcaaggcgctgagcgcgcccttctcgctccgcctcacctccgactccggcaaggtcctcgtcgccagcaatgtcatcccggccagctggaaggccggagggacgtaccgctccttggtgaattattaaccttaaattacagctagctgggagcgtgatcgaaggcgtgcttcgggcttcggccttcgggaggtggcgttgcatgcatccgggctttggcgagaggcggtgccagaagacgaggaggaggttgaggaatggaattcttcccactccctccacggtctctgcagtcccgtggtgtctgaacgtgctgttgatttctctgtaattttgtatttttctctcttttttttctttgtcgtcccgtagttgcgagaggcgcgacgagactgatgtcgcatgccaatgtatcaagctgtgtgtgtgtttgtaccacgcaatcttttcatataaatgaattgcggctgttgccaaaaaaaaaaaaaaaaa

SEQ ID NO: 96536 - protein, 294 aa, Zea mays
  misc_feature: Ceres CLONE 1682867
  misc_feature (102)..(184): Pfam Name: DPBB_1 Pfam Description: Rare lipoprotein A (RlpA)-like double-psi beta-barrel
  misc_feature (196)..(279): Pfam Name: Pollen_allerg_1 Pfam Description: Pollen allergen
MAKSCTLLFGTVLVVLLLLVSPIACSRKLAKPTNKHRPRHKPAAVRARSNHTATPSVSDAYGSGGWLSAGATYYGAPDGDGSDGGACGYQTAVGQRPFSSMIAAGSPSLFKEGKGCGACYEVKCDSNAACSGKPATVVITDECPGGVCLAEAAHFDMSGTSMGAMAKPGMADRLRASGILKVQYKRVPCKYSGVNIAFRVDQGSNPFYFEVLVEFEDGDGDLSAVDLMEAGCGTWTPMVQNWGALWRYNSNSGKALSAPFSLRLTSDSGKVLVASNVIPASWKAGGTYRSLVNY

SEQ ID NO: 96537 - DNA, 777 bp, Zea mays
  misc_feature: Ceres CLONE 1683947
  misc_feature: Encodes the peptide sequence at SEQ ID NO. 96538
aagagcattagtgagctgttgcaaaaagcaaaaaatatcgtctagcatcagtagcatccccctgcagtgctggccacataatggcgaataagtccgctgccgctgctattctgctcgccgccgccgtgctcggctgtcttgtctcggcgtcgctcgccgaccagggcaccgccacctactacaccgtctacactccgtcggcgtgctacgggaaccaggacgagggcacgctgatcgcggcggcgagcgacgcgctctggaacggcggcgccgcgtgcggcaccatgtacacggtcacctgcgtcgcgggcaccaacgagaccccgaacccctgcaaccccggcgcctccgtcaccgtcaagatcgtcgacctctgcccgtcgcccggctgccaggccacgctcgacctctcccagcaggccttcgccaccatcggcaacctcggcgccggcaagatcgtcatcgactacagccaggcgtaagatacatgcatgttgtgggaagaagcacgaactatacgtacatacatgcaaaagattcattcaagcttatatatattattcggggatgagttagtaaatactaagcaataacaaatcatgtcgtattagtctcaagctacgactatacaatcctagtgcaaacaagtgatttgtttgctgaaataatgatctgcaccatacgagtgtgcgtgtataatcgtacctttggagaaataaataaccgggcagtcgggcttatctaaagcaaaaaaaaaaaaaaaaaaaaaaaaaaaaa

SEQ ID NO: 96538 - protein, 133 aa, Zea mays
  misc_feature: Ceres CLONE 1683947
  misc_feature (52)..(130): Pfam Name: DPBB_1 Pfam Description: Rare lipoprotein A (RlpA)-like double-psi beta-barrel
MANKSAAAAILLAAAVLGCLVSASLADQGTATYYTVYTPSACYGNQDEGTLIAAASDALWNGGAACGTMYTVTCVAGTNETPNPCNPGASVTVKIVDLCPSPGCQATLDLSQQAFATIGNLGAGKIVIDYSQA

SEQ ID NO: 96539 - DNA, 754 bp, Zea mays
  misc_feature: Ceres CLONE 1684616
  misc_feature: Encodes the peptide sequence at SEQ ID NO. 96540
atctcacggctagctagcacaagcatagtgcaggggcttgccacctaagtaaggcccgcctgagagccatggcatccaaggccgtcctcttcttggctctcaacctcctgttcttcacggtggccaacgcctgcggcaactgcccgaccccaacgcccccggtcgagccaccgccgccgcctcctgctgctaccccacccccttcgtccagcggcaagtgcccgctgaacgcgctcaagttcggcgtgtgcgccgatgtgctcggcctcgtcaaaggcgaggttggcaaggtgcctgccgagccatgctgtaccctcatcaaaggccttgcggacttcgaggccgccgtctgcctctgcacggccatcaaggccaacgtgctcggcgtcgtcgtcgatgtccccatcaagctcagcgcgctcgtcaactactgtggcaagtgcgtgcccaagggctacatgtgcgcgtaagcagctccgggcggttacacgctcgtagctgttcacgtacgagattatatatgcacgcaccctgcatggcacgaatgcatgcattgtgtccgctgatatatctctcctgtctcagttgtgcacctagctttcggttctacaaaacctagaaccattccagccaaatacttgtcagttcaattcgcatgtattgtctcttgttgaattcccattatttttcttttgtatttggtcatttcctcgtaagagtccgacaccttctcgaaggaaaaaaaagaggggtg

SEQ ID NO: 96540 - protein, 133 aa, Zea mays; identical to SEQ ID NO: 52393
  misc_feature: Ceres CLONE 1684616
  misc_feature (51)..(132): Pfam Name: Tryp_alpha_amyl Pfam Description: Protease inhibitor/seed storage/LTP family

SEQ ID NO: 96541 - DNA, 1454 bp, Zea mays
  misc_feature: Ceres CLONE 1684639
  misc_feature: Encodes the peptide sequence at SEQ ID NO. 96542
agcacaagcagtaccctgctgtgctgcctgcaagcagctagtgtccaccgccagaaactagctagctagctagcatgggtcggctggcggcggcgctggccgccgtggcggtgctctgcgtgaccttggcggcgggagcggaggtggtggacgagttcggcggcggggcgtccttcatcttcggggactcgctggtggacgccggcaacaacaactacatcccgacgctgtcccgggccaacatgaccccgaacggcatcgacttcgcggcgtcgggcggggcgcccacggggcggttcacgaacgggcggaccatcgcggacatcatcggcgagatgctggggcaggcggactactcgccgccgttcctggcgcccaacgcgacgggcggcgccatcctgaacggcgtcaactacgcgtcgggcggcggcgggatcctgaacgccacggggaaggtgttcgtgaaccgcatcgggatggacgtccaggtggactacttcaacgtcacgcgggggcagctggacgcgctgctgggcagggacagggcccgcgagtttttgaggaggaaggccatcttctccgtcaccgtcggatccaacgacttcctcaacaactacctcatgcccgtgctgtccacgggcacgaggatccgcgagtcgcctgacgccttcgtcgacgacctcatcttccacctccgggaccagctcacgaggctgtacacgctggacgcgcgcaagttcgtggtggccaacgtggggccgctgggctgcatcccgtaccagaagaccatcaaccgagtgggcgaggacgagtgcgtgaagctgcccaaccagctggcggcgcagtacaactcccggctcagggagctcatcatcgacctcaacgccggcctccccggcgccaggttctgcctcgccaacgtctacgacctcgtcatggagctcatcaccaactaccccaactacgggttccagacggccagcgtggcgtgctgcggcaacggcgggtcgtacgacgggctggtgccgtgcgggccgacgacgagcctgtgcgacgcccgggacaagcacgtgttctgggacccgtaccacccaagcgaggccgccaacgtgctgctcgccaagtacatcgtcgacggcgactccaagtacatctcccccatgaacctcaggaagctctactccctctagccgcacgtccgacgtccggacgaccatttcatttgccatttggccggccgtccacgtcgacccacctttgcacttgcgcgttcccggcgtgtgcagcgccaactgtgtcgtgtgcggtgtgtactgcatgcgaactgtaatttttgggtgcgaggaaattaattttagcatgcaatttcgatcgtatgtatgtaacttgtaccgtatccaaacaattaaactaaagacatcgaatccaaggacacacaaaaaaaaaaaaaaaaa

SEQ ID NO: 96542 - protein, 371 aa, Zea mays
  misc_feature: Ceres CLONE 1684639
  misc_feature (34)..(352): Pfam Name: Lipase_GDSL Pfam Description: GDSL-like Lipase/Acylhydrolase
  misc_feature: SWISSPROT Homolog: EC 3.2.1.51 Alpha-L-fucosidase
MGRLAAALAAVAVLCVTLAAGAEVVDEFGGGASFIFGDSLVDAGNNNYIPTLSRANMTPNGIDFAASGGAPTGRFTNGRTIADIIGEMLGQADYSPPFLAPNATGGAILNGVNYASGGGGILNATGKVFVNRIGMDVQVDYFNVTRGQLDALLGRDRAREFLRRKAIFSVTVGSNDFLNNYLMPVLSTGTRIRESPDAFVDDLIFHLRDQLTRLYTLDARKFVVANVGPLGCIPYQKTINRVGEDECVKLPNQLAAQYNSRLRELIIDLNAGLPGARFCLANVYDLVMELITNYPNYGFQTASVACCGNGGSYDGLVPCGPTTSLCDARDKHVFWDPYHPSEAANVLLAKYIVDGDSKYISPMNLRKLYSL

SEQ ID NO: 96543 - DNA, 1580 bp, Zea mays
  misc_feature: Ceres CLONE 1684660
  misc_feature: Encodes the peptide sequence at SEQ ID NO. 96544
aacttctcgtgcgaagaagaaagttttctcttgcttgatccgccattcagaagccgttgtcccagctaatccgagctaggcacgctcccatccgacgtcgtcccagctagcacagccatttccgtttcgtttcttccactgcagtcagaactcagaagcagaggccgccgttgcaagcatgccgccgatggaggccgccgaggacgtcgtcatcgtcggcgccggacttgccggactcgcggtggctctcggactgcacaggaaaggggtgaggagcctggtgctggagtcgtcgccgtcgctgcgcgcgtcggggttcgccttcaccacgtggacgaacgccttccgggcgctggacgccctcggggtgggcgacaagatcaggaggcagcaccagcaggcgcaggcgctacgcgtcatggcttcttccaccggagaaatcgtacaggaagtggacctgacgcagcaggggaaacgagggcccaacgagatccgttgcgttcggcgggacctgctgctgcaggccttggaggaggagctaccgagaggcgccatccgctactcgtccaggatcgtgtccatcgaggaggaggacggcaacggcgacaaggtcctgcaactaaccgatggttcagtcatcagagcaaaggtgctcgtcgggtgcgacggggtcaactccgtggtggccaaatggctcggcctcgccacgccgtcctactcggggcgctcggcggcgagaggcttcgcgcgttacccggacggccacggcttcgagcccaagttcctgcagttcgtcggccacggcttccgctccggcatgctgccgtgcaacgacaccgacatctactggttcttcacctggactccttccgagaacgacaagggcgtcgacgagagcgcggccaagatgaagcagttcgtgctggccaagctccggggctccaataaggtgcccgcggaggcgctggcggcgatcgacaggagcgagatgagcgacgtgctcgccgcgccgctgcggttccggtcgccgctgtcgctggccaccgcgagcatcgccaggggcagcgcgtgcgtggccggcgacgcgctgcacccgatgacgccggacctcggccagggcggctgctcggcgctggaggacggcgtcgtcctggcccgctgcctcggcgacgccctgctgccgccgccagctggcagtggcagtggcagtggcaggggcaaggaggaccgggtccaggcggccttgcgcgagtacgcctggatcaggcggtggaggagcgtcgagctcgtcgccacctcctacaccgtcggcttcgtccagcagagtgacagcgcggtcgtcagcttcctgcgggacaggctcctgtcgggagtgctcgctcgaaggcttctgaaaatggcggactacgactgcggcacgctcgaaagctactagcccccttgtactgtttcctgtgtgtacatcagtacacgtgttgtgttgtgcctgctgctggaataatatgcctactgttatgtgttattagtagaaaattgtactgcaatatcatcacctctgttgcacaaaaaaaaaaaaaaaa

SEQ ID NO: 96544 - protein, 418 aa, Zea mays
  misc_feature: Ceres CLONE 1684660
  misc_feature (7)..(374): Pfam Name: FAD_binding_3 Pfam Description: FAD binding domain
  misc_feature: SWISSPROT Homolog: EC 1.14.13.90 Zeaxanthin epoxidase
MPPMEAAEDVVIVGAGLAGLAVALGLHRKGVRSLVLESSPSLRASGFAFTTWTNAFRALDALGVGDKIRRQHQQAQALRVMASSTGEIVQEVDLTQQGKRGPNEIRCVRRDLLLQALEEELPRGAIRYSSRIVSIEEEDGNGDKVLQLTDGSVIRAKVLVGCDGVNSVVAKWLGLATPSYSGRSAARGFARYPDGHGFEPKFLQFVGHGFRSGMLPCNDTDIYWFFTWTPSENDKGVDESAAKMKQFVLAKLRGSNKVPAEALAAIDRSEMSDVLAAPLRFRSPLSLATASIARGSACVAGDALHPMTPDLGQGGCSALEDGVVLARCLGDALLPPPAGSGSGSGRGKEDRVQAALREYAWIRRWRSVELVATSYTVGFVQQSDSAVVSFLRDRLLSGVLARRLLKMADYDCGTLESY

SEQ ID NO: 96545 - DNA, 1036 bp, Zea mays
  misc_feature: Ceres CLONE 1685062
  misc_feature: Encodes the peptide sequence at SEQ ID NO. 96546
aaagaggaagaaaaaacgagctcttttgcactacgtccatagtgcatgataccgatgatggcgaagaagcaccttgccgctgtcttcctcgccatcctgctggctctcgcggctggcgccaccggcatgcgcgcgtccgagatcgacgacggcatgccgctgatccacatgctgcgcccgctgctgcattccggcggcgacctcggccggcgcggccgcgtgccgtgcgacagctggcggttcgctgtggagaccaacaccctccgcgactgggacactgtcccagcccgctgcgagaagtacgtcggcaactacatgctcggcgggcactaccgcagcgactcccgagccgtcgccaacgaggccatcgcctacgccgagggcctcaacctcaccggccaaggcaaggaggtctgggtgttcgacgtcgatgagacgacgctctccaacctcccctactatgctaagcatggcttcggggttgagccatacaactggtcgacgttcggcgcgtacgtgaaggaggcgaacgcgccggtgctgccggagacgcagcggctgtacaagaggctgcaggcgctgggcatcaagccggtgatcctgactgggcgacgcgaggacaagcgggaggccacggctaacaacctcgccgcggcgggctacaccggctacttgaagctgctgctcaagcctcagaacgtcaaggtgagttcgattgagttcaagtccggcgagcggaagaagctgcaggacgccgggtacgtcatcgtcggcaacatcggcgaccagtggactgacctcctcggcgagccggagggcggccgcacgttcaagctgcccgaccccatgtactacatcggctagctgctctgctctctaccggccgatcgatcgggcgcgggagcgatcgagagaacaccagcaaataaacgtcgtcgtctcaattattaataacgttgtcgttcatcatcgtcactgattcagtgtaccaaataaaacagcctcataaattatacagcaaaaaaaaaaaaaaaaa

SEQ ID NO: 96546 - protein, 272 aa, Zea mays
  misc_feature: Ceres CLONE 1685062
  misc_feature (44)..(272): Pfam Name: Acid_phosphat_B Pfam Description: HAD superfamily, subfamily IIIB (Acid phosphatase)
  misc_feature: SWISSPROT Homolog: EC 3.1.3.2 Acid phosphatase
MIPMMAKKHLAAVFLAILLALAAGATGMRASEIDDGMPLIHMLRPLLHSGGDLGRRGRVPCDSWRFAVETNTLRDWDTVPARCEKYVGNYMLGGHYRSDSRAVANEAIAYAEGLNLTGQGKEVWVFDVDETTLSNLPYYAKHGFGVEPYNWSTFGAYVKEANAPVLPETQRLYKRLQALGIKPVILTGRREDKREATANNLAAAGYTGYLKLLLKPQNVKVSSIEFKSGERKKLQDAGYVIVGNIGDQWTDLLGEPEGGRTFKLPDPMYYIG

SEQ ID NO: 96547 - DNA, 776 bp, Zea mays
  misc_feature: Ceres CLONE 1685276
  misc_feature: Encodes the peptide sequence at SEQ ID NO. 96548
aagcgcgtctctggtgctctcgcaaccaccgtgcgcttgctttcctcctgctctactccgttgcacacttgtactaggcctggaggtcctgtagctcgcctggtgctgtgtcggagacggtggcaatggcattgcaggagcaggaggcggacggcgacgagggcggggaggaagacgacgaaggcgaggatgagcggatgacgggatacggtgtgggggagctgatatctgcttgtcccgaggcgtgctgtccgcttgcggcggtgtaggagtaagatattggcgcaataggctcaatcatttttttttttgcttctctctttctctttttcccttttcttccttgtttgatgtggcgtgcttgtttttttttttttgttgcctttttttgtttctgattgatgagaccaatgttgattatatgatgaagagttgattggtaagaacgctaaggggcctctaagatggacaatataaggtataaaggctcgttaacatagatttatatacgcgctaggtttgagaggcttaacctcgtggcgttttatcgaacacgccttgttgattcggcaaggaacacgggtgggacgctgctgtttgctgatgtggtgttggtcggccaagaaatgtgatgaacacgggtaagacgccgctgtagcattgactgaaacacagacgaacatgtcgaggacatgctactattttgttacgatcttagtatactgtatacccgtttttctgtatccaattcgacgttacaaaaaaaaaaaaaaaaa

SEQ ID NO: 96548 - protein, 47 aa, Zea mays
  misc_feature: Ceres CLONE 1685276
MALQEQEADGDEGGEEDDEGEDERMTGYGVGELISACPEACCPLAAV

SEQ ID NO: 96549 - DNA, 465 bp, Zea mays
  misc_feature: Ceres CLONE 1685457
  misc_feature: Encodes the peptide sequence at SEQ ID NO. 96550
atatatatccaacaaccagcagtgcaacaagcaagatttacctgcccatcgatcatatcgtcaactggtccggcagttcgcgacaccatgagctccacggagtgcggcggcggcggcggcggcgccaagacgtcgtggcctgaggtggtcgggctgagcgtgaaggacgccaagaaggtgatcctcaaggacaagccggacgccgacatcgtggtgctgcccgtcggctccgtggtgaccgcggattatcgccctaaccgtgtccgcatcttcgtcgacatcgtcgcccagacgccccacatcggctgataatatataagctagccgctatttcctttccttgccccagaacttgaaataaatatatatacgatgaaataacgcgggcatgccgaataatggatgtgtgaattctcactaattaagtaatgcataaataaacgtattcaaaaaaaaaaaaaaaaa

SEQ ID NO: 96550 - protein, 73 aa, Zea mays
  misc_feature: Ceres CLONE 1685457
  misc_feature (14)..(73): Pfam Name: potato_inhibit Pfam Description: Potato inhibitor I family
MSSTECGGGGGGAKTSWPEVVGLSVKDAKKVILKDKPDADIVVLPVGSVVTADYRPNRVRIFVDIVAQTPHIG

SEQ ID NO: 96551 - DNA, 846 bp, Zea mays
  misc_feature: Ceres CLONE 1685519
  misc_feature: Encodes the peptide sequence at SEQ ID NO. 96552
gctcattcacggcaaattaagcgagcgccggccgaggcagacacaacccgcagcaacaacttgcatcggcacggacgaccgattgagagcctcggcgttcgtacgccacgccaccaagagactctgtgcaacaagtgaagggacgaaatgtatccggccaagcccgccgcctcctccagccagccagcggccgagatggcgcagccggtggtcggcatccccatcagcagccccggcgcggtcgcggtcgggccggtcgtcggcaagtggtcctccggcctctgcgcctgctccgacgactgcggcctctgctgcctgacgtgctggtgcccgtgcatcacgttcggccgcatcgcggagatcgtggaccgcggcgcgacgtcgtgcggcgtggcggggaccatctacacgctgctggcctgcttcacgggctgccactggatctactcctgcacgtaccgctccaggatgcgcgcgcagctcggcctccccgaagcctgctgctgcgactgctgcgtccacttctgctgcgaaccctgcgcgctctcccagcagtacagggagctcaaggcccgcggattcgaccccgacctcggctgggacgtcaacgcgcagaaggccgccgccgccgccgccatgtacccgccgccggcggatgggatgatgatccgctaagctaagctagctacctcgtcgccgatccggcccaacctccaacgctaaactcagatgcgttgcgtcagtcagatcatcgcgtacgtacgtgttttgtacgtatggtcgtgtatatttgtacgtgatgcgtatatatataacgttatgactgaatgtctcagttttcagatt

SEQ ID NO: 96552 - protein, 175 aa, Zea mays
  misc_feature: Ceres CLONE 1685519
  misc_feature (41)..(140): Pfam Name: PLAC8 Pfam Description: PLAC8 family
MYPAKPAASSSQPAAEMAQPVVGIPISSPGAVAVGPVVGKWSSGLCACSDDCGLCCLTCWCPCITFGRIAEIVDRGATSCGVAGTIYTLLACFTGCHWIYSCTYRSRMRAQLGLPEACCCDCCVHFCCEPCALSQQYRELKARGFDPDLGWDVNAQKAAAAAAMYPPPADGMMIR

SEQ ID NO: 96553 - DNA, 800 bp, Zea mays
  misc_feature: Ceres CLONE 1685966
  misc_feature: Encodes the peptide sequence at SEQ ID NO. 96554
aagttgcaccagctctcctcctcctatccctagcccaccagtccagtccgcaagcatccctctgctttgcgcagtgctgttgggttttttcagcctccatggcatcgtccaaggccttcttcctcgtggccctcaacctggtcctcttcacggtggccaacgcctgcggcggcggctgcccgacgccaacgccgccaaccccgacgccgccgtcgccttcaaccggtggcaagtgccccaagcacgcgcttaagttcgctgcgtgcgccaacgtgctgggcctcgtcagcgccgaggtcggccacccgcccgccgagccgtgctgcagcatcctcggcggcctcgccgacttggaggccgccgtctgcctctgcaccgccatcaaggccaacgtgctcggcatcaccgtcgacatccctgtcaagctcagcctcattatcaactactgtggcaagaacctcccaagtggcttcatatgcgcctgatagatactctgatagatagctgcgcgtgtgacgtacttcgcatgcatgcagcccatgcattggctgtctccttctacctttttcttttgtctttgctttgtcatgttagcttggttctgaatgtagaagtactctagacaatgaagctagtgtgagtcaaatcattttcttttttgagtgaagcgtgttgcgttgcgtgcctatattatcttcttcaaggtctagataggctagctaggaactgcatgcagtgctatttgtctatgtttcctatccaccgttgtactcctttgattccaaaaaaaaaaaaaaaaa

SEQ ID NO: 96554 - protein, 128 aa, Zea mays
  misc_feature: Ceres CLONE 1685966
  misc_feature (46)..(127): Pfam Name: Tryp_alpha_amyl Pfam Description: Protease inhibitor/seed storage/LTP family
MASSKAFFLVALNLVLFTVANACGGGCPTPTPPTPTPPSPSTGGKCPKHALKFAACANVLGLVSAEVGHPPAEPCCSILGGLADLEAAVCLCTAIKANVLGITVDIPVKLSLIINYCGKNLPSGFICA

SEQ ID NO: 96555 - DNA, 795 bp, Zea mays
  misc_feature: Ceres CLONE 1687177
  misc_feature: Encodes the peptide sequence at SEQ ID NO. 96556
aggtaaaccattcccctccgccccacctcttgtccagtgccccaaatgctggcgaccacctgcagccggccgccgtgcccgtgcccgtgcccgtgcgcgcggtcgcggcggctccccgcggcgaccttcggcggcaccagtagcgcgaagcgaagggcgccgaggagagcggcggcggcggtgcggtgcgggctgctgcccgtggacccgtgggcgccgacgatggactcccagagcgtggcgtcgcagctcttcgccgtctcgctcttcccctacctgggattcctctacttcatgaccaggtccaagaccgcgcccgggctcacgctcttcggtttctacttcctcctcgtcttcgtcggcgccaccatacctgctgggatttacgcaaaagttcattatggtacctcactgtccaacgttgactggctgcacgggggcgctgaatcgctgctgactctcaccaacctgtttatcgttttggggctgaggggagccctgaggaagctggaggaagagggcacagacgagagcgtttctgaagcttctcaagaaaaaagttctgtctagatgggttcatcatcagtacccctgaaggtgcactcagtaactaggagtgcgctgtttttcttcttctgcagctcaactagctcgtagtgatgttttgggtgtaaggaaatctggcagatctactctctgcatactatgctgataagaaaacaatgtacaggcatctcctgcaattctgagtagtaccttcagctgttgatagtagcagaaaaaaaaaaaaaaaaa

SEQ ID NO: 96556 - protein, 174 aa, Zea mays
  misc_feature: Ceres CLONE 1687177
MLATTCSRPPCPCPCPCARSRRLPAATFGGTSSAKRRAPRRAAAAVRCGLLPVDPWAPTMDSQSVASQLFAVSLFPYLGFLYFMTRSKTAPGLTLFGFYFLLVFVGATIPAGIYAKVHYGTSLSNVDWLHGGAESLLTLTNLFIVLGLRGALRKLEEEGTDESVSEASQEKSSV

SEQ ID NO: 96557 - DNA, 661 bp, Zea mays
  misc_feature: Ceres CLONE 1687226
  misc_feature: Encodes the peptide sequence at SEQ ID NO. 96558
ccctagaaaaaaagccacctacaccaccaccccgccggccacactcgtctttctcacgagccacaggcacaggcaggctctcgagctcagtccacccatcgcaggggatggcgtcgtcgttcgccgtggcaacggtcccgtcgctggcggccccggcggccaagaagcggtccggcggcgtcacgtacgtggagggcatgaacgcctacagcggcctcaaggggctcaacaaggtgaacatgctcggggtgcgcaagaccgccgactactccttcgccaaggtcgtggcgtcgctcagccccgcgggcaggaagcggcgcggcggcgcgttcggcgcccagatgaacgccgccgccgagatcttcaggatcgccgccaccatgaacggcctcgtgctcgtcggcgtcgccgtcgggttcgtgctgctccgggtggaggccgccgtcgaggagtccgagtagggtgcgtgggcctgccactgtcggctgtcgccccgggccgcagtctgcttcagaaaccgtgatatatataaccagatgtacgctttcgattcaatttactttggtatgtatccatgacaattggtgaatactgtggaaatatgtttttggagtcgaggcctgcaattgatcttcaggtgatctaaaaaaaaaaaaaaaaa

SEQ ID NO: 96558 - protein, 117 aa, Zea mays; identical to SEQ ID NO: 57210
  misc_feature: Ceres CLONE 1687226
  misc_feature (79)..(115): Pfam Name: PetM Pfam Description: PetM family of cytochrome b6f complex subunit 7

SEQ ID NO: 96559 - DNA, 597 bp, Zea mays
  misc_feature: Ceres CLONE 1687241
  misc_feature: Encodes the peptide sequence at SEQ ID NO. 96560
aaactttgccagatcgtcgtcgtcgtcatcgtgccgtacgtacgtgctctagctaaccgtagcgtcggccggcggtcgcgtgggcagggcagcgggcaacggagggcggcaccggcatggacaggatcctggccatgtccctcgtcggtgcggggccaggcaacgtcttcggcccgggcatgagcgccggcgcgctggagagcttcgcacgccccgcggggcgcgccaggacggagcgcagcggcggcaggggtggcgcggcggcgcgcggcgcaaggtcggcgtcggcggagaagtgcggcgccgaccagatcaggacgggtgcggcggaggctgacggtgccggtggccaggagggacgcgccgccggtgcggacgcgacgcggtacggcccggcggcgttggaccgcgggttctgcttcgacgccgtcgtcgcaacgtactgacatgcgcgccgccacgtggcgcaagttctcggcgagttcttgtttggacgcgatattaagaggacgacaataccgacgccaactacttctttctcattaatttctcaagcagttcgggttcttttttttttgggaaaaaaaaaaaaaaaaa

SEQ ID NO: 96560 - protein, 109 aa, Zea mays
  misc_feature: Ceres CLONE 1687241
MDRILAMSLVGAGPGNVFGPGMSAGALESFARPAGRARTERSGGRGGAAARGARSASAEKCGADQIRTGAAEADGAGGQEGRAAGADATRYGPAALDRGFCFDAVVATY

SEQ ID NO: 96561 - DNA, 536 bp, Zea mays
  misc_feature: Ceres CLONE 1687478
  misc_feature: Encodes the peptide sequence at SEQ ID NO. 96562
agcagtcagcagtgaccaactcgaagcttgcgttcttgtagtagaggtcggcagcaagcggtagagcgagaggtcgagaagatgaagagcagcactctgttggcgatcctagttctccaggcccttctggtctctacggccgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtctccacggacaagggcgccaccaagtacagatgccgcgacttcctccccgaaaactgcggctgcaagatccactagactcatccacagcggcacagccgatggatccttccatgctcctccgtccgtccgccttgctacaagcaggcagccaccaataagctagctcttgttgttgttttgcatgtttgattgggtgtcccttcccagtcgagatggaataatgtcaggcgcacgtacagacgtgttattaaaaaaaaaaaaaaaaa

SEQ ID NO: 96562 - protein, 87 aa, Zea mays; identical to SEQ ID NO: 61660
  misc_feature: Ceres CLONE 1687478

SEQ ID NO: 96563 - DNA, 1555 bp, Zea mays
  misc_feature: Ceres CLONE 1689145
  misc_feature: Encodes the peptide sequence at SEQ ID NO. 96564
agctccatcttcaggctgctagtactcagtagtcagtacagtggtgacgacgacgacatgacgaagatctcccgctcgttgctcgtcgtgccgccgctgctcatcgcgctgctcctcctcggccctcacctcccgccatccgacgcgctgacgcccaagcagggcgtcaagtccaagaccttcctgtccccgcccatcctgcttcgcccgggcgacgtggccgacaagttctactacgacatccccttcccccggggccacctggcgctcaagagcttcaacggcgaggtggtggacgagcgcggcgcccccgtgccgctccacgagacgtacctccaccactgggtcgtgcagccctactacgccctggtagtatcggcggagggcggcagcagccggccgcggaccatcccggcgcgcaacgccggcgtgtgcagcggccacacgctgggccagtactacgggctggggtccgagacccggcgcacggccacgtgggtgcccgacccgtacggcatcgagatcggcgacccggccgcggcgcccgccagcgagggctacgagcagcgctggctgctcaacgtgcacgccatcgacacgcgcggcgccgccgaccggacgatggcgtgcaccgagtgccgctgcgacgtgtacaacgtcacggcggactggcgcgggcacgccatcgagcccgggtacgccggcggcctgcgctgctgctacgacggcacgcggtgcggcgccgcggcggcgggggcgggggcggaggcggaagcggccaggactgtgttcctgcgctacacggtgatgtggcgcgactggagccccgcggcggtgctgcccgtgcggatctacatcttcgacgtggccggctgcggcgtggagtacgacgtggaggagcagtgcagcggcggcgcgggcggggagtgcgtgcacgtgaagacggccacgcaggcgctgccgcggggcggcgacgtggtgttcggcgtggcgcaccagcacgcgggcggcgccggcgcgtcgctgcacggcgccgacggccgcctgctgtgcgagtccgcagccacgtacgggggcgggcgggaggccggggacgaggcgggctacatcgtcggcatgtccacgtgctacccgcgcccgggcgccgtcacggtgcgcgacggcgagccgctcaccgtcgtgtccaggtacagcagcgaccgccgccacacgggcgtcatgggcctcttctatatcctcgtggccgaccacgctcggcagctgccgcagcaggagggcctgtgcttcagcttcccggtcccatggtgcctaccgtcatggctgtcgagcaacctgtgagatctttgttgcagttgaaagctgttagctgcttggttagggttcggggctggtcagcaaggaaggccgcgtgggtccttgcgttattactcatacagtagtagtaatgtaaaatatactagtagaagcagcggtcagtctactctgctgttgctgtatttttatacaataaccaccacgtcgctccgtttgacttcaagaaaaaaaaaaaaaaaaa

SEQ ID NO: 96564 - protein, 426 aa, Zea mays
  misc_feature: Ceres CLONE 1689145
  misc_feature (31)..(407): Pfam Name: SURNod19 Pfam Description: Stress up-regulated Nod 19
MTKISRSLLVVPPLLIALLLLGPHLPPSDALTPKQGVKSKTFLSPPILLRPGDVADKFYYDIPFPRGHLALKSFNGEVVDERGAPVPLHETYLHHWVVQPYYALVVSAEGGSSRPRTIPARNAGVCSGHTLGQYYGLGSETRRTATWVPDPYGIEIGDPAAAPASEGYEQRWLLNVHAIDTRGAADRTMACTECRCDVYNVTADWRGHAIEPGYAGGLRCCYDGTRCGAAAAGAGAEAEAARTVFLRYTVMWRDWSPAAVLPVRIYIFDVAGCGVEYDVEEQCSGGAGGECVHVKTATQALPRGGDVVFGVAHQHAGGAGASLHGADGRLLCESAATYGGGREAGDEAGYIVGMSTCYPRPGAVTVRDGEPLTVVSRYSSDRRHTGVMGLFYILVADHARQLPQQEGLCFSFPVPWCLPSWLSSNL

SEQ ID NO: 96565 - DNA, 1865 bp, Zea mays
  misc_feature: Ceres CLONE 1689257
  misc_feature: Encodes the peptide sequence at SEQ ID NO. 96566
aacaccctctccggcctctcgtccgctccaatcccgatcctatctatccggcatggccgccgccgcaggcccgccgtcgcacagcgcggacctgatgccgccgccgccccctccgcccgtcctgacgacgactgcgccccgtcctcgccgccgcgcaagggaagttagctcccggtacctctcaacgcccgtcccctcgaccccgcgcctctccaccgcctcctccacgcggtcgcgctccccgtcgccgacgccgtcgcctcgtggacggcagcgggcggtcacgcccttcgccaacgagaaccacccacccccgccgccgcctcccacgggcaccgttgcgcgccggcgggccgtccagaagcttttcgaggaaatcggcgccggcaacccgcgcgcctcggtgagctccaactcctccgccgtgcccgcagctactccgcggccgctcccgcgctccaccagcgggccggccgcacccaccgcgcggagagggtacccgcgccttccgacgcccgcgcgtgctggctcctgcccggcttccggcgcggtggattccgacaccgcctcttgctgctcttcgtctgatacgtcgtccacggccactgacttgtctgaggcggatcgggcgctcgggatggctccagccgcgccgtgcgagagcccgccgctgctgggcccagcgtcctgccgcgggggacgcctttcgtcagagctctgctcgtcggtgccggagtcgggcggatcctcgcgggcgtccaacccactgtgctaccgctcgctcaactcggcactgtcaatctcaacggcgatggctgggaagttgacggcggcagggaggccaccacagccgcaagggccgaaggtagctgatctgaagaaggcggcgatcctggggggcaggaaggttgcggggaagcaggaagacgtgcacctgctgcggctgatggacaattcgtacctccagtacaggttcctcaacgcccgggctgaggcagcaggcaaggcccaggcggcggctgcagagaaatccttgtacggagtcgaggagaggattgccagcctcagggtatctgtcgccgagaagagagcagaggtagagaggatgaaaagggagcatatattgagatcagtagtaaatgagcaggtgccatatttgattcagtggggtgagattgaggggtgtcatgcaagctgtcttagaggagcaacaacagcgctgtctaacacctcgctaaggctaccaatcattgggagtgtaaatgtaaactgtggggaagttacagaagtcctaaagtcagcagcacaactgcttgaaccgctttcacctttcatcgagaattttctgccaaaggttgaacaaaccggcgatgtggcctctaatctggcccaggttatcgctactgagagaaccttgatagaggagtgcggtaatctcctataccaagcacaaaacctgcagatgagggagtccagcttgaggagtcaagtgatgcaactgaagcaaaatgaagcaaagtaaaacgacctaggactaggagtcaggtgatgcaactggaacaaaacgaagcgaagtaacacgccgccagggcgtttgttcaaccaagtgagctaactgtgctccaccgttgttggatgtccaagaggacggaagttgcctgatcatatatacatgaccaaggcataagtgggttctacgaattgctgattcttttccagtacatatgttatgcagtttgctgtggaaacattttcgttgtctgcctattggaaaggcagatacaggcagagttttacaaatggaaattggttgattcttaaaaaaaaaaaaaaaaaaaaaaaaaaaaaaaaaaaaaaaaaaaaaa

SEQ ID NO: 96566 - protein, 489 aa, Zea mays
  misc_feature: Ceres CLONE 1689257
  misc_feature (136)..(489): Pfam Name: DUF566 Pfam Description: Family of unknown function (DUF566)
MAAAAGPPSHSADLMPPPPPPPVLTTTAPRPRRRAREVSSRYLSTPVPSTPRLSTASSTRSRSPSPTPSPRGRQRAVTPFANENHPPPPPPPTGTVARRRAVQKLFEEIGAGNPRASVSSNSSAVPAATPRPLPRSTSGPAAPTARRGYPRLPTPARAGSCPASGAVDSDTASCCSSSDTSSTATDLSEADRALGMAPAAPCESPPLLGPASCRGGRLSSELCSSVPESGGSSRASNPLCYRSLNSALSISTAMAGKLTAAGRPPQPQGPKVADLKKAAILGGRKVAGKQEDVHLLRLMDNSYLQYRFLNARAEAAGKAQAAAAEKSLYGVEERIASLRVSVAEKRAEVERMKREHILRSVVNEQVPYLIQWGEIEGCHASCLRGATTALSNTSLRLPIIGSVNVNCGEVTEVLKSAAQLLEPLSPFIENFLPKVEQTGDVASNLAQVIATERTLIEECGNLLYQAQNLQMRESSLRSQVMQLKQNEAK

SEQ ID NO: 96567 - DNA, 915 bp, Zea mays
  misc_feature: Ceres CLONE 1689307
  misc_feature: Encodes the peptide sequence at SEQ ID NO. 96568
agcccaccaaaccgcgccacccattgttgtcgcttctcacttctcactcaccaaccaacccaaccgagcaacttggctcgtaccgtacgtagtacctgctgcgacacgccgaggagctagacctgttggagctaggacagtcagacacgagacgacagagaccatgtcgacgacgacgatgaaggcgagcgacccggggtccgcgtggttcggcagcggcgcacgcacccggtcggcggcggggataagccacaacgcgcggctcgtcaccaccgcggtcgccgcgttcgtgtccgtgctcggcctcgccctcttcctccacctctacgtctgccacgtgcgccgccgcaaccgccgccgcgcggcggcagtgctgccgacgaccacggccgccgcggcggcggcggcggccccgaagcgcgggctggatcccgcggccgtcgcggcgctgccgaccgtcctctacagggacgcgggcggcgccgacgatggcgccgagtgcaccatctgcctcggcgccgtgcaggaaggcgagctggtgcgggcgctcccggcctgcggccacgtgttccacgtcccctgcgtcgacacctggttcgcgtccagctcgtcgtgcccggtctgccgcgccgaggtcgagccgccgccgccgccgccggcactgagctcatcggctcggttcgtgcaggcggagaaggcggcgcaggacgccgtcaaggaggaggccggcagctccacgccggagagggggatcggtgcctgcgcgtcgctgatgaagatgctcagcagggagaggccggcgccgcggaggccacacgccgacgccggggacttggacgacttggaacggcagcagcattctgttgccgtcaataattagcctattgttttttattagaaaaaaaaaaaaaaaaa

SEQ ID NO: 96568 - protein, 238 aa, Zea mays
  misc_feature: Ceres CLONE 1689307
  misc_feature (113)..(154): Pfam Name: zf-C3HC4 Pfam Description: Zinc finger, C3HC4 type (RING finger)
  misc_feature: SWISSPROT Homolog: EC 6.3.2.19 Ubiquitin--protein ligase
MSTTTMKASDPGSAWFGSGARTRSAAGISHNARLVTTAVAAFVSVLGLALFLHLYVCHVRRRNRRRAAAVLPTTTAAAAAAAAPKRGLDPAAVAALPTVLYRDAGGADDGAECTICLGAVQEGELVRALPACGHVFHVPCVDTWFASSSSCPVCRAEVEPPPPPPALSSSARFVQAEKAAQDAVKEEAGSSTPERGIGACASLMKMLSRERPAPRRPHADAGDLDDLERQQHSVAVNN

SEQ ID NO: 96569 - DNA, 534 bp, Zea mays
  misc_feature: Ceres CLONE 1689435
  misc_feature: Encodes the peptide sequence at SEQ ID NO. 96570
caccaaactgctagcggcgtcagcgcccaacctaatttcccccctcacctccccatctcccggcgtcggcatggccaccgacgtgctgcgcgcgcgcaacatcctcttgccggcgccgccgcagaggatccgggcggcggcggcggcgcgccggagggcagctggtagcgacagccaccaccccggcgccaccgccaccaggaggaggtcgccggcggccgggacatcgtcccccgcggcggggcgaagacaccccggcggcgggagggcgaggcctgcggcggaggtgtacgccggcccatcgttctcgacgtccgccgacgcgagcttgctgccgctaccgcagtttgctgccaggaaggccgtggccgtggccatgacgaccgccgtcaatgccgccgacgcgacgcgcgacctcaggcttatcctgcggctggagtagccatcgtgacacatagctcgtctgcgagctctaacgctggcttcgatttctcttattaattcttccttctttatcataaaaaaaaaaggaga

SEQ ID NO: 96570 - protein, 123 aa, Zea mays
  misc_feature: Ceres CLONE 1689435
MATDVLRARNILLPAPPQRIRAAAAARRRAAGSDSHHPGATATRRRSPAAGTSSPAAGRRHPGGGRARPAAEVYAGPSFSTSADASLLPLPQFAARKAVAVAMTTAVNAADATRDLRLILRLE

SEQ ID NO: 96571 - DNA, 590 bp, Zea mays
  misc_feature: Ceres CLONE 1689506
  misc_feature: Encodes the peptide sequence at SEQ ID NO. 96572
aacagcctccatctcccaatctcgcaggcgacgccgacgcgttccaccggcggcaccgatgcgggcgatctcgacggccgcggggggcatgctgcgcgcggcggcggcggcgacgacgccggggcacgaggaaaggcccaaggggtacctcttcaaccgcccgccgccgccgccgggggagacgcggaagtgggaggactgggagctgccctgttacatcacctccttcctcaccgtcgtcatcctcggcgtcggcctcaacgccaagcccgacctcacgatcgagacctgggcgcacgagaaggcgctggaacgcctcaagcagcaggagctagccgccgtctccggaggcggtgacgccgatgccgacgccgagtgatccgctggtcagatcacccgcaactctagagatattgttttttcttttcttttctttctggtttcctgcttgtgtcgcgcggttcaataaggctgtctgtactgagatgcatgtcatgagattccagaaatggatggacatcagactgaacactgtatcattgttgctgtttcgctggataacttacacttcacaaaccttgcaaaaaaaa

SEQ ID NO: 96572 - protein, 106 aa, Zea mays
  misc_feature: Ceres CLONE 1689506
MRAISTAAGGMLRAAAAATTPGHEERPKGYLFNRPPPPPGETRKWEDWELPCYITSFLTVVILGVGLNAKPDLTIETWAHEKALERLKQQELAAVSGGGDADADAE

SEQ ID NO: 96573 - DNA, 547 bp, Zea mays
  misc_feature: Ceres CLONE 1689689
  misc_feature: Encodes the peptide sequence at SEQ ID NO. 96574
gttcatccactctcagcatcaccagctaagaacaggtcttcgtctcaataatggaaggcaaaacagggcagctcaggtgctgtttcgtcgccatcgtgctcgtcctgggtcttgtccttgagcagtcccagcaggctgaagctagaggcaaatggtgctgcgaaaccgccaccggaaaataccattttaatcgctgcgttgactcgggttgggtcgacaatattgggttctgtgcgagtaatgccggttgcatcattatggaggacagatgtggaggtcgttggccagtgcctgctcgtgatgcgctttctctggatgtcatttgattaattataagcaagtacgtgaagttaagaaacgagggccagacgactgtcgtccagcgattggttatttgtgaacttgtcgtttgtcttcttatttcaactttccaataagccccttcgtgtaatcgtgtcctccccttcaaagtttgtcgactgttgcgtaatcaaatctatatagcaaataaagacggcgccgtacgtgttaaaaaaaaaaaaaaaaa

SEQ ID NO: 96574 - protein, 91 aa, Zea mays; identical to SEQ ID NO: 58513
  misc_feature: Ceres CLONE 1689689

SEQ ID NO: 96575 - DNA, 520 bp, Zea mays
  misc_feature: Ceres CLONE 1690092
  misc_feature: Encodes the peptide sequence at SEQ ID NO. 96576
gcccgcactaccacgcgaccacgcccccgctcctctcgtctctttcttcgcctcttccatcgcaggattcggcggccatgggcggcggcaacggccagaagtccaagatggcgcgcgagaggaacgccgagaagaacaagggcggcaaaggcagccagctggaggccaacaagaaggccatgaacatccagtgcaagatctgcatgcagaccttcatctgcaccacctccgaggccaagtgcaaagaacatgcggaggcgaggcatcccaagaacgacctctaccagtgcttcccccacctcaagaattagtaagcagcagaagcatatgatctgctcagctaaaagacaagtactacatatatatatatacgctgtgtgtcaattaatgggttgtaggctgctgttgatgcggctgcttcgttcgtgttgccccgtctgattatgtactgtaacccttggctgtcaacgtactgtgctaaaaaccactggttctgtgtggataaaaaaaaaaaaaaaaa

SEQ ID NO: 96576 - protein, 77 aa, Zea mays; identical to SEQ ID NO: 59663
  misc_feature: Ceres CLONE 1690092
  misc_feature (4)..(73): Pfam Name: DUF1909 Pfam Description: Domain of unknown function (DUF1909)

SEQ ID NO: 96577 - DNA, 1042 bp, Zea mays
  misc_feature: Ceres CLONE 1691246
  misc_feature: Encodes the peptide sequence at SEQ ID NO. 96578
actggaaggctggacctttccaagtctcaaaccagagcgaggccgcactgcccgcgagtcctccactccgaccgcacgatggctgcgctgcgcctcgcctccttcaccctccgccccgccgctgccgcggcctccgcctcctccggcgggaccccagccgcgtccggctccgtctccgtctccttcgcccgcgcggcgcgagggctgccctccctccgcctggccccgccccgccgccgcggggacctcgccaggcctcgcgccgcggccgaggccgcggcggagagctacgcgtccgcgctgtcggaggtggccgtcgagaacggcaccctcgagcagacggtctccgacctggagaagttggagaaggtcttcgcggacgaggccgtcgccgagttcttcgacaaccccaccgtcccgcgcgaggagaaggccgagctcatcgacgagatcgccaggtcgtccgagctgcagccgcacgtcgtcaacttcctcaacgtcgtcgtcgacaacttccgcgcggccatcgtgccgcagatcgtcgccgagttcgagaacgtctacaactcgctcacgggcaccgaggtcgccaccgtcacctccgtcgtgcagctcgagtcgcaggacctggcgcagatcgcgcagcacgtccagaagatgaccggcgcccagaacgtccgcatcaagacgcagctcgacccggagctcatcgccggcttcaccgtgcagtacggccgtgacggctccagcttaatcgacatgagcgtccggaagcagatcgaggagatcgcgtccgagttcgagttgcccgccgtcccgctcgaagtctgaccggcccgaggcgtcctccatcctcgcccatgagatgctttggtgcttcctgctgcctctctccctgctcttcatgtgtaccattctctgattgaatatttgagtgaatggtgaatactgcatacctggatttcaggattcatatttgaatgaatggtggatacaccgcatacctggattccaggatcgtattgaaaaaaaaaaaaaaaaa

SEQ ID NO: 96578 - protein, 250 aa, Zea mays
  misc_feature: Ceres CLONE 1691246
  misc_feature (67)..(241): Pfam Name: OSCP Pfam Description: ATP synthase delta (OSCP) subunit
  misc_feature: SWISSPROT Homolog: EC 3.6.3.14 H(+)-transporting two-sector ATPase
MAALRLASFTLRPAAAAASASSGGTPAASGSVSVSFARAARGLPSLRLAPPRRRGDLARPRAAAEAAAESYASALSEVAVENGTLEQTVSDLEKLEKVFADEAVAEFFDNPTVPREEKAELIDEIARSSELQPHVVNFLNVVVDNFRAAIVPQIVAEFENVYNSLTGTEVATVTSVVQLESQDLAQIAQHVQKMTGAQNVRIKTQLDPELIAGFTVQYGRDGSSLIDMSVRKQIEEIASEFELPAVPLEV

SEQ ID NO: 96579 - DNA, 889 bp, Zea mays
  misc_feature: Ceres CLONE 1691247
  misc_feature: Encodes the peptide sequence at SEQ ID NO. 96580
aagctaccccctgcagctccgagcttttactttgactccactctaccgctcctccagcctcctgttgtcttgtgttgtgttgtctcccactgcaacaatccgcccggctagctacctcctcctccgcctgctagtgtgctctacctagctcgatcagcttgccggccgcccggcgccccgcgtccccatccatcgatcgcccgccaccagccgccgccgccgccgctgctgctgtgcgctgcgcctggcggcgcgtcggcgcctgcccgcagcatgagaagcaggcggtggtcccgcgccgcggtgctcgcgtggctagtgctggtcgcggccgccgcgtgcgtcgccgacgagtcgcgcgcggtgcccgccgccaggaaccggaccgggaccgggaccgcggccgtcagtgtcaggcagcagcagcagcagcggggcgcgttcgacgtcgtggtcgccggcctcgtcagcatcgggctcggccgccggtggcgcgccggcggcatggtggacgaggacaagcgccgcgtgcccacggggcccaacccgctgcacaaccgatgagctagcgggctagcgccgccaccgcgcgcgccgcgcgtgccttgccttgccttgcctgcctaggcgcgcgcggcctagctagctatacctacccttatcgatcgacgatcgagctgcatgcggcggccatcgccgctgcgcgtgcgacgcccggcgggctcgccggtggtctggtctctctcgctcgcgcgcgcgcccgcggcgcatggcgaggcggaggagaagaacgagaaggagaagtgaggagcgtgttagtattttttttaccactattcccttctgcttcgctttcttctcttttcccccctaaaaaaaaaaaaaaaaa

SEQ ID NO: 96580 - protein, 96 aa, Zea mays
  misc_feature: Ceres CLONE 1691247
MRSRRWSRAAVLAWLVLVAAAACVADESRAVPAARNRTGTGTAAVSVRQQQQQRGAFDVVVAGLVSIGLGRRWRAGGMVDEDKRRVPTGPNPLHNR

SEQ ID NO: 96581 - DNA, 715 bp, Zea mays
  misc_feature: Ceres CLONE 1692370
  misc_feature: Encodes the peptide sequence at SEQ ID NO. 96582
aagatcagcggaaggcacaccgagctcttgcctgcctgcctccactccaccaaatggcgatgccgagggcggcgggcgcggggtcgctccgcttcctgggcctgctgaagcagccggagtccgacgccgccgccccattcgagctcgacgagcgcgacgtgttgtggccggcgggcggggggcagcaggacggttgtgccgccccgccggcgaggcgtcgtcgcgcgcacgccgtgccgctgtacagcttcgggctgtcgtcgctgctcgccgaaggctgcggcggcggggtgcccgtgcccgtgcccgtgccggggagggcgatggcgccgagcgccgcgccgaggcagtcggcgccggtgcgcgtgccggcgccgtggccaggcggcaggagggccgacgaggacgaggaggacggcgaggaggtggtgccgccgcacgtggtcgcggcgcggcgccacgcgcggtcgtcgtccgtgctggagggcgccgggcgcacgctcaagggccgcgacctccgtagcgtccgcaacgccgtgctccggcagaccgggttcttggacctgtgaacgtccgcaggcaggcgacagcccagccatggcagaaagacgccgatcgatacattgttgtgtgtctgtgtgtcgttctagtgtcccttacaagttacacatgaagaactgaactcaatacgttcaatcaaaaaaaaaaaaaaaaa

SEQ ID NO: 96582 - protein, 171 aa, Zea mays
  misc_feature: Ceres CLONE 1692370
  misc_feature (27)..(170): Pfam Name: DUF584 Pfam Description: Protein of unknown function, DUF584
MAMPRAAGAGSLRFLGLLKQPESDAAAPFELDERDVLWPAGGGQQDGCAAPPARRRRAHAVPLYSFGLSSLLAEGCGGGVPVPVPVPGRAMAPSAAPRQSAPVRVPAPWPGGRRADEDEEDGEEVVPPHVVAARRHARSSSVLEGAGRTLKGRDLRSVRNAVLRQTGFLDL

SEQ ID NO: 96583 - DNA, 3008 bp, Zea mays
  misc_feature: Ceres CLONE 1693547
  misc_feature: Encodes the peptide sequence at SEQ ID NO. 96584
acgccaaacccgacacactcgtcgcgtcgcggagcttctctcctcgcctcttcatgcgccatcgccgccgcctccacctctgcgacgcccacagataggcaggaggaggagggggcgatgccttcgatctcctgccacaatctcctcgacctcgccgcggccgacgaggtgcctctgccgtcgcccacgccgctccgcctcccgcgcgtcatgtccgtcgcgtccccggcctcgcccacctcgccgcccgcgcccgccccgccgcgccgcgtcatcgtctcccaccgcctgccgctccgcgcgtcgccggacccggcggcgcccttcgggttcgccttctccgtcgacgccggcaccgtcgcttaccagcttcgctcggggctgcccgccaacgcgcccgtcctccacatcggcaccctcccagccgccgcggccgaagccgcctcagaggagctgtccgactacctgctagccaatttctcgtgcctgcccgtgtacctccccaccgacctccaccaccgcttctaccacggattctgcaagcactacctctggccgctcctccattacctcctcccgctgacgccgtcgtcgctcggcggcctgccgttccagcggacgctctaccactccttcctctcggcgaacagggccttcgccgaccgactcaccgaggtgctgtgccccgacgaggacctcgtctggatccacgactaccacctcctcgcgctcccgaccttcctccgcaagcgcttcccgcgagccaaggtcggattcttcctccactcacctttcccctcgtcggagatcttccgcaccatccccgtgcgggatgacctcgtccgcgccctcctcaacgccgacctcgtcggcttccacaccttcgactacgcgcggcacttcctgaccgcctgctcgcggctgctcggactcgactaccagtccaagcgcggctacatcggcatcgagtactacggccgcaccgtcacggtcaagattctccccgtcgggatcgacatgggccagctcagatcggtggtctcggcgccggagacggaggatgcggtgcggcgggtgaccgaggcgtacaagggacggcgcctcatggtcggcgtcgacgacgtcgatctgttcaaggggatcgggctcaagttcctggcgatggagcagcttctcgtggagcaccgggagctccgcggccacgccgtgctcgtgcagatcgccaaccctgcgcgcagcgaggggcgcgacgtgcagggcgtgcaggacgaggccagggccatcagcgcccgggtcaatgcgcgcttcggcacccccgggtacacgccgatcgtgctcatcgacgccccggtgacgccgcaggagaaggccgcctactacgcggctgccgagtgctgcgtcgtcagcgccgtccgcgacgggctcaaccggatcccctacatctacacggtgtgccggcaggagagcaccgcgctcggagacgactcgcccaagcggagcgtcatcgtgctctcggagttcgtcggttgctccccgtccctgagcggcgcgatccgcgtcaacccgtggagcgtggagtccgtggcggaggccatgaacgccgcgctgcggatgccggaggccgagcagcggctgcggcacgagaagcactacaagtacgtgagcacccacgacgtcgcctactgggcgcggtccttcgactcggacctgcagcgcgcctgcaaggaccatttctcgcgccggcattgggggatcggcttcggcatgagtttcaaggtggtggcccttggcccgaatttccggcgcctctccgtggagcacattgtcccgtcgtatcggaggacggataaccggctgattctcctggactacgacggcaccgtgatgccggagaactccatcgacaggacgccgagcagtgaggtcatctctgtgttgaatcgtctgtgcgaggaccccaagaacagagtgttcatcgtaagcggacgggggaaggacgagctgagcaggtggttcgccccctgcgagaagttgggcatcgccgcggagcacggttacctcacaaggtggagcagggacgcgccatgggatacctccgggttggccgccgacttcgactggaagaagaccgcggagccggtgatgcagctgtacacggaggcaacagatggctcctacatcgagcacaaggagagcgccatcgtgtggcaccaccacgaggcggatccggacttcggttcctgccaggctaaggaactgctcgaccatctcgagaacgtgctggccaacgagcccgtggtggtgaagagaggccagcacatcgtcgaggttaacccccagggcatcagcaaaggcgtggtagtggacagcctcctgtcgtcgatggtgaggacggggaagccgccggacttcgtgctgtgcatcggcgacgaccggtcggacgaggacatgttcgagagcatcgtgtgcccggcctccaacagcggcgtgaagctgccggccascagcgaggtgttcgcttgttcggtgggyaagaagmsgagcatggccctcaggtactacctggacgacmcggtggacgtggtcaaratgctggacggcctgggctagcgcgccgtygcagcagcggcccaggccggcggtgcagytgcgggtctcgttcgaaggctcgttctgagggggaagaggagaacacacagcgctagtagcmgcagtaaacagcaaacatcsmgcaaggataaccagtggtgatgaacacaacgagattcagcagacggcgtggtgtcggattgattagctgcagtttacaggatccgayattttttttgctttcttctacattactaccccaaatctttcgtgcctgtatatgcccgcatggtaatatgcaaagaataacgtttcgaccaccaaccaccattgtacatgtagttgacgatgacgacgagatcagaaaaggagaagtggggaaaaaaaaaaaaaaaaaaaaagaaaaaaaaaaaaaaaaa

SEQ ID NO: 96584 - protein, 830 aa, Zea mays
  misc_feature: Ceres CLONE 1693547
  misc_feature (49)..(533): Pfam Name: Glyco_transf_20 Pfam Description: Glycosyltransferase family 20
  misc_feature (582)..(819): Pfam Name: Trehalose_PPase Pfam Description: Trehalose-phosphatase
  misc_feature: SWISSPROT Homolog: EC 2.4.1.15 Alpha,alpha-trehalose-phosphate synthase (UDP-forming)
  misc_feature (796)..(796): Xaa is any aa, unknown, or other
  misc_feature (805)..(805): Xaa is any aa, unknown, or other
  misc_feature (808)..(808): Xaa is any aa, unknown, or other
  misc_feature (819)..(819): Xaa is any aa, unknown, or other
  misc_feature (824)..(824): Xaa is any aa, unknown, or other
MPSISCHNLLDLAAADEVPLPSPTPLRLPRVMSVASPASPTSPPAPAPPRRVIVSHRLPLRASPDPAAPFGFAFSVDAGTVAYQLRSGLPANAPVLHIGTLPAAAAEAASEELSDYLLANFSCLPVYLPTDLHHRFYHGFCKHYLWPLLHYLLPLTPSSLGGLPFQRTLYHSFLSANRAFADRLTEVLCPDEDLVWIHDYHLLALPTFLRKRFPRAKVGFFLHSPFPSSEIFRTIPVRDDLVRALLNADLVGFHTFDYARHFLTACSRLLGLDYQSKRGYIGIEYYGRTVTVKILPVGIDMGQLRSVVSAPETEDAVRRVTEAYKGRRLMVGVDDVDLFKGIGLKFLAMEQLLVEHRELRGHAVLVQIANPARSEGRDVQGVQDEARAISARVNARFGTPGYTPIVLIDAPVTPQEKAAYYAAAECCVVSAVRDGLNRIPYIYTVCRQESTALGDDSPKRSVIVLSEFVGCSPSLSGAIRVNPWSVESVAEAMNAALRMPEAEQRLRHEKHYKYVSTHDVAYWARSFDSDLQRACKDHFSRRHWGIGFGMSFKVVALGPNFRRLSVEHIVPSYRRTDNRLILLDYDGTVMPENSIDRTPSSEVISVLNRLCEDPKNRVFIVSGRGKDELSRWFAPCEKLGIAAEHGYLTRWSRDAPWDTSGLAADFDWKKTAEPVMQLYTEATDGSYIEHKESAIVWHHHEADPDFGSCQAKELLDHLENVLANEPVVVKRGQHIVEVNPQGISKGVVVDSLLSSMVRTGKPPDFVLCIGDDRSDEDMFESIVCPASNSGVKLPAXSEVFACSVXKKXSMALRYYLDDXVDVVXMLDGLG

SEQ ID NO: 96585 - DNA, 1963 bp, Zea mays
  misc_feature: Ceres CLONE 1693766
  misc_feature: Encodes the peptide sequence at SEQ ID NO. 96586
aatttttccctttccgtttcgtaccttcttcctcatcctcctcctcctcccgtgagccatgaatgagctctgcgacctcgaggtgcacatcaatggccatcacacgcttcatctccaccagagcgtcatgtgcgccttctcggggaggctgaggacactggtgaagcaggagaagaagaagaagggcggcggcaggaaggaagccgtgtccatcaatctcgccggcggcttcccgggcggcgccgacggcttcgagctcgtggccaggttctgctacaacgacggccgcgtcctgctctgcccctccaacctcccgctcctgcactgcgccgccgtgtccctggagatgaccgaggaggtgtgcgcctgcaacctgctggcgcaggcggaggccttcgtgaacggcctctactactggacctggggcgacgtgctggccgcggtccggagctgcgagcccttcgccgcggcggccgacgcctcgggactcctggacaggctcatctccgcgctcttctccaagatcaccggcgccaccccgggcccgccggggacgccgaaccgctcctcgtcgtcgtgctcgtcgtcgcccgacaccgcgggcttgcgccgctcgtcgtcgtccgccaacaagacgccggagtcgatgcggccctgcgccggcagggagtggtggttcgacgacatgacgtcgctgtccccgccgaccgtcgagaaggtgatgcgcgtgctcggctgctacggcgtcgagaacaagaacctgatcctcacgcggttcctgctgcactacctccgcgccgccacgcgcaggccgccggcgcttgagcgggagggcgccgcgctcgccggcctcgcggacacggccgtccacggcgtggcgctcgtcgggggcacggcgttctcgtgccggggcctcttctgggtgctacggatcgtgtcggcggtggggctgagcagggagtgccggcacaagctggagcggctcatggggctcatgctggaccaggccacgctcgacgacctcctcgtctccggcgacgacggcggcggcgtgtacgacgtcaacctggtcatgaggctggtcagggtgttcgtggcctcccaagaggaggcagacgcgccgtcggagaggatgcggaaggtggggcgcctggtcgacaagtacctcggcgaaatctcgccggaccaggggctgaaggtgtccaagttcctcgccgtcgccgagagcctgccggactcggccagggactgctacgacggcgtgtaccgggcgctggacatctacctcgagtcgcacccagcactgtccctggaggagcgcacgacgctgtgccggtgcctcaactacgagaagctgacgctggaggcgtgcaaggacctggccaagaaccggcggatcccgccgggcgtggcggtgcaggcgctggcgtcgcagcagtgcaagctccacatcagcgagccgggccccggcgggagcgcgacggcggcagcggggaaggagcgccggcccgacccgtcctcctgctcccagtcccagacgccgaggaggagggtcgcccgccgcgccacccgcagcgtggacctcggcagaaggagcggcggcgacgacgacgagaaggagctgctgcggctgaacctgcagagaatgcagagccgggtggtggagctggagcgggcgtgcaaggagatgaagggccagatgtccaggatggccaagggcaagtccttgtccttgtccttcggctccggcgccgcctcctgccaccagaccggcggcaggggcttgcctaggctctgctgacgtgatgcatgggcctgtaactttttgatcctctttattttttccttccctctctatctctttcatggcttgcgattttcctcttgatccctttgtaaagctaattacttggttggtggagtggagcattgcttggtcgtcctttaaaaaaaaaaaaaaaaa

SEQ ID NO: 96586 - protein, 580 aa, Zea mays
  misc_feature: Ceres CLONE 1693766
  misc_feature (203)..(438): Pfam Name: NPH3 Pfam Description: NPH3 family
MNELCDLEVHINGHHTLHLHQSVMCAFSGRLRTLVKQEKKKKGGGRKEAVSINLAGGFPGGADGFELVARFCYNDGRVLLCPSNLPLLHCAAVSLEMTEEVCACNLLAQAEAFVNGLYYWTWGDVLAAVRSCEPFAAAADASGLLDRLISALFSKITGATPGPPGTPNRSSSSCSSSPDTAGLRRSSSSANKTPESMRPCAGREWWFDDMTSLSPPTVEKVMRVLGCYGVENKNLILTRFLLHYLRAATRRPPALEREGAALAGLADTAVHGVALVGGTAFSCRGLFWVLRIVSAVGLSRECRHKLERLMGLMLDQATLDDLLVSGDDGGGVYDVNLVMRLVRVFVASQEEADAPSERMRKVGRLVDKYLGEISPDQGLKVSKFLAVAESLPDSARDCYDGVYRALDIYLESHPALSLEERTTLCRCLNYEKLTLEACKDLAKNRRIPPGVAVQALASQQCKLHISEPGPGGSATAAAGKERRPDPSSCSQSQTPRRRVARRATRSVDLGRRSGGDDDEKELLRLNLQRMQSRVVELERACKEMKGQMSRMAKGKSLSLSFGSGAASCHQTGGRGLPRLC

SEQ ID NO: 96587 - DNA, 616 bp, Zea mays
  misc_feature: Ceres CLONE 1695402
  misc_feature: Encodes the peptide sequence at SEQ ID NO. 96588
agaggccccgtccgtcccaactcacgtgtacgtactcctcctgtcctgctgactgatccgcatgctgccggtcgtccaccgccgatcgtgaaacgcaaccgtcgccgaagaaggccgcggcgctgccgctgccggagatgatgcaggaggagatcatcccgccgctgaaggccgccttggaggcggaggaggacgtgtcccaggtccagctcgccttcgaaaacaacacgctagagggatccttcataaaggacgacgtcccttattgtttctgggccttctttccaaaaggagacctcacaggacccaagggcttcgcgctatcgtcctacagcaacgaggtgagcaccatcgagccgttcctgatcgacgagaagagggtaacggccaagtacgtggtgttctgggtttacaagaggctggctgggcaaggcatccttccggtctggaaggaagaggagggggaggatcatcaggacgccaagtagaacacacgcaggaggcaggagggtgctgctgtgaacctacacacagtcatcatgtctgaaactgttaaagttcgtctgctaatatatatacagatgctaagagctgctgagaaaaaaaaaaaaaaaaa

SEQ ID NO: 96588 - protein, 116 aa, Zea mays
  misc_feature: Ceres CLONE 1695402
MMQEEIIPPLKAALEAEEDVSQVQLAFENNTLEGSFIKDDVPYCFWAFFPKGDLTGPKGFALSSYSNEVSTIEPFLIDEKRVTAKYVVFWVYKRLAGQGILPVWKEEEGEDHQDAK

SEQ ID NO: 96589 - DNA, 468 bp, Zea mays
  misc_feature: Ceres CLONE 1696277
  misc_feature: Encodes the peptide sequence at SEQ ID NO. 96590
aactcagtgctcaccgaactccatctatctcttccccacgaacgcttgcggcggcggcggaattaggaggcgatggggcactccaacgtctggaactcgcaccccaagaactacgggcccggatcccgcgtctggcagtgcttccgcagcaatgccaaggacattggcttcatcaagtaccgctgaaatcaggtgggaatggaccatgtggtagaggcgaggctgtagttttatttccagtaatttagatgttttgttcagaagtctgctagtaaagactgctacgtttatgatgaagaacttagccatgttggtcatattgatcatgagttacctatgttgagcttaaactatcttgtgtccaaccatcgctgggtagtatgattactgtaatgtagggtggttaaggtcgcaaactaatacttatattgcatgtgtcgaagatctaaaaaaaaaaaaaaaaaaaaa

SEQ ID NO: 96590 - protein, 37 aa, Zea mays
  misc_feature: Ceres CLONE 1696277
MGHSNVWNSHPKNYGPGSRVWQCFRSNAKDIGFIKYR

SEQ ID NO: 96591 - DNA, 768 bp, Zea mays
  misc_feature: Ceres CLONE 1697802
  misc_feature: Encodes the peptide sequence at SEQ ID NO. 96592
aatcgtcactcgcgcctcggtgagctgcttcaattgaaggctgcacaccgctgcaggctatatagctagtctgcagagatgcttgggaggagcaggaggaggagaggcggcgcctcgccatccaagtcgcaggaacccaccaacaccggcgcggccgtcactgctgacgccggccagggcgcggcgaccggcgcgtcgcagtcgcagctcgtcacgcggctcgatgagtctgccacgacgaggctgcaacgcatgagccacaggctgagcctgctcgagcagcacatggaaacactggaggccgacgttgccaaggccagcacggactcgtacgagtagagcagtactcctaggtagcgatctttgcagacgaacgagcttgtcaggttccagcgtcgaattcagcatggctactccaccagccagtgctatctattgctcgggcggctaagtatataatttttagaaggatcatggatacatttcgtgtccgcagatagtaattgtttatctgtgaagactacgggcaacacagacttgctttggggctgactcgccggcttccgaaacacggaacggatcgggtgcttgacgacgcctttgcgccgtcgtaggggcgttggctgtcgtatattttgaagcttgttccccgaaagtcagacctgcaactgcaatgggatggggttccaattccaacccacaatggaaaagaaaaagaaataagaccctccttttgttcatcaaaaaaaaaaaaaaaaaaaaaaaaaa

SEQ ID NO: 96592 - protein, 86 aa, Zea mays
  misc_feature: Ceres CLONE 1697802
MLGRSRRRRGGASPSKSQEPTNTGAAVTADAGQGAATGASQSQLVTRLDESATTRLQRMSHRLSLLEQHMETLEADVAKASTDSYE

SEQ ID NO: 96593 - DNA, 788 bp, Zea mays
  misc_feature: Ceres CLONE 1698496
  misc_feature: Encodes the peptide sequence at SEQ ID NO. 96594
aatcaccaagactcagccaatacaagggaagcagaagacgacgtaggtctcctaaaggaagcacaaaggaattgaacatggccacttctcacaagcttcagccggtcctcgctgtcatgttcttcaccatctttgtgataggagcgaatggcgagcgatgcaacacgtcgagcatcgcggtggacaccgtcaacaccggcgcgacggtaccctggggagacaccatcttctcggtggaggtgaagaaccggtgcccatgcgccgtcaggaacgtgcgcctcgacggcgggggcttcgcgaccacggtggacgtggaccaggccgccttccgtgccgacggcggcggcggcagcggcgtctacctggtgaacggcggcgagccgatcgcgagtatggccgccgtcagcttccagtacgcctgggaccatttcttccagatgactccgaggagcttggaggtcgacgacgacggccagctgtgctagctacgaggaggaccgaccgtatcgtgcatggattggtgcccttactgtatcttataaaagctcaacatgtgtttcccggcctgctagctgggtgttttgttcagctgggtggctagcttatagactgccatccttcgtatatatacagagtgttctagtggattaagtatagtgtttgtttcagtatgttcagagactgagagagatgtacggtgagtttagactgggagatagatacaaagtgttgatcgagttcgacgaaggccctgtttaatttcgttcagctaaaaaaaaaaaaaaaaa

SEQ ID NO: 96594 - protein, 135 aa, Zea mays
  misc_feature: Ceres CLONE 1698496
MATSHKLQPVLAVMFFTIFVIGANGERCNTSSIAVDTVNTGATVPWGDTIFSVEVKNRCPCAVRNVRLDGGGFATTVDVDQAAFRADGGGGSGVYLVNGGEPIASMAAVSFQYAWDHFFQMTPRSLEVDDDGQLC

SEQ ID NO: 96595 - DNA, 847 bp, Zea mays
  misc_feature: Ceres CLONE 1698538
  misc_feature: Encodes the peptide sequence at SEQ ID NO. 96596
aaccgtagcccccgaagacacactccaagataccaagaacaccggccacacgcacgcgcgcgcgcaccgacgcacggcaggcgaggccgaggacgaacacacgataaaggaagcaatggctccgtcgctcgcgtcgacggcggggctcccgagctgcgcggcgcggcgcggcggccggtgcgtggcccgccgcgcgtccgcggttgcggctccggcgacggcgacggcgacggcgaggacgcactacgaggtgctcggggtcggggccggcgcgagccggtgcgagatcaaggcggcgtaccggcgcctggcgagggaggtgcacccggactgcggcggccgcggcgacgaggggttcatccgcctgcacgccgcgtacgccacgctcgcggaccccgacgagcgcgcgcgctacgaccgcgccgcggcggtccggagccggatcagggcggcgccgtcggggtccggagcggggttccggccgcggaggtgggagacggaccagtgctggtagcaccgtagcagcagccacgtagacgtagctgcgccggcggtggagtggagtcgccggagcgcgctcggtggtctggtccgtttccagggccagttgcgaccagcgggcccatattgaagacggcccacatgaaaaacggaccgcgatccgggcagcccacaatcacatgagttgggatcgtggactccacaatcacatgagttgggatcgtggactttatgggctgcaggcttcgtaggcctttcgcgccagacttggcgctggatgttgttgtaggccatcatagagctgcacgaagaggcatttttaacatcccaaaaaaaaaaaaaaaaa

SEQ ID NO: 96596 - protein, 132 aa, Zea mays
  misc_feature: Ceres CLONE 1698538
  misc_feature (42)..(101): Pfam Name: DnaJ Pfam Description: DnaJ domain
MAPSLASTAGLPSCAARRGGRCVARRASAVAAPATATATARTHYEVLGVGAGASRCEIKAAYRRLAREVHPDCGGRGDEGFIRLHAAYATLADPDERARYDRAAAVRSRIRAAPSGSGAGFRPRRWETDQCW

SEQ ID NO: 96597 - DNA, 2134 bp, Zea mays
  misc_feature: Ceres CLONE 1699710
  misc_feature: Encodes the peptide sequence at SEQ ID NO. 96598
aggcctcgccgccatggcttcctccctggccgccctccactcagccgccgccagccacctcccacaccctcgacgtcagaggaccgccgccctcgcgcgcgcctctcctctcctccgcctgccgcttcgcctccgctcccgccgggtccccgggtcgccgccaagaacctcgcagttggcgaccggcgccgctggcggcacggcaaccggcagggcgaggcggagcgtgggcgtcgacgtcgccgccctcgccgcggcgctgcgcgacgccagaacggccgacgacgtggaatcctcggtgaacgcctttttgagcgacgacgaggaccggctcctgccgctccaggtgtacacgtgcgtcatccgggggctcggcaagggcaacagcccggacgccgcgttcgccgtcgtcgagcacctcaagcggagaggggtggtgccgaaccagttcgtgtacaactgcctcctcggcgccgtcaagagctgcggcgagctcggccgggtccagtccgtcctcgacgacatggaggcgcagggggtgcccccgaacatcgtcaccttcaacacgctgatgtcgatccacgtccagcagggcagggtggaggacgccctcagggtgtacgccgacgtccaggggcgagggctcgtgccgaccgccgcgacctactccacggtgatgtccgcctacaagaaggcgggggacgcgtccgcggccatccagctcttcgccctgctcagggagaggtacaggaacggagagctggtggggagccgtggtgacccggagcaggagctcgtcaagctcgagaagctgaccgtccgagcgtgctacctgtcgatgcggcggtcgctcgtcgcggggaagaatccggtcggcgaggcgctgaaggtcctcctggacatggacgaagcaggtgtccggccggagcggagcgactacgagcggctcgtctgggcgtgcacccgggacgagcactacgccatcggcaaggagctgtaccagaggattcgcgacggtggcgacgagatcagcctgtccgtctgtaaccacctgatctggctgatgggcaaggcgaagaaatggtgggcggctctcgagatctacgaggacctgctggacaaagggccgaagccgaacaacctgtcccacgagctgatcatgtcgcactttaacgtcctcctggacgccgccaagcgaaggggcatctggaggtggggcgtcaggctgctggacaagatgcaggagaagggactgaagcccgggggcaaggagtggaacgcggtcctcctcgcgtgctcaagggcgtccgagacgtcggcggcggtggacgtcttcaagaagatgatggagcgggggctgaagccggacgtggtctcctacggagcgttgctgagcgcgctcgagaaaggcaggctctacgacgaggcactgagggtctgggaacacatgcgcaggctcggcatcgaacccaacctctacgcgtacacgatcctggcgtcgatctacatcggcaagggcgaccacgccatggcggacgctgttcttcacgacatgctgtcgaagcggatcgcgccgaccgtcgtcaccttcaacgcgataatcagcgcgtgcgcgaggagcggttcgggtgggaacgccttcgagtggttccacaggatgaagacgaagggcattgagccgaatgagatcacgtaccaggtgttgattgaggctcttgtgcaggatgggaagccaagacttgcctatgagatgtacatgaaggcttgcggccagggtcttcagcttcctgcaaagtcgtatgacaccgtgctggaggcgtgtaaggcttatggttccgtagtagatgtagctactctgggtcctcgaccttccaaaggggtggaagtggaacccatcaggatagagaatagcttctccagtctctctcagttcaaggatgtgcatggcagctctcatcgttttgcaggcgttggaatgtatgggttttacggatacagaatggcaaggtaaacaaaccaagcatgtaacctactatcaatccccctctccctcttgtaatcaccctcccaaacccaatgccacattttaaaacatttgacttgtgtatttgtaagctaaaaaaaaaaaaaaaaa

SEQ ID NO: 96598 - protein, 665 aa, Zea mays
  misc_feature: Ceres CLONE 1699710
  misc_feature (524)..(558): Pfam Name: PPR Pfam Description: PPR repeat
  misc_feature (454)..(488): Pfam Name: PPR Pfam Description: PPR repeat
  misc_feature (181)..(215): Pfam Name: PPR Pfam Description: PPR repeat
  misc_feature (419)..(453): Pfam Name: PPR Pfam Description: PPR repeat
  misc_feature (111)..(145): Pfam Name: PPR Pfam Description: PPR repeat
  misc_feature (342)..(376): Pfam Name: PPR Pfam Description: PPR repeat
MASSLAALHSAAASHLPHPRRQRTAALARASPLLRLPLRLRSRRVPGSPPRTSQLATGAAGGTATGRARRSVGVDVAALAAALRDARTADDVESSVNAFLSDDEDRLLPLQVYTCVIRGLGKGNSPDAAFAVVEHLKRRGVVPNQFVYNCLLGAVKSCGELGRVQSVLDDMEAQGVPPNIVTFNTLMSIHVQQGRVEDALRVYADVQGRGLVPTAATYSTVMSAYKKAGDASAAIQLFALLRERYRNGELVGSRGDPEQELVKLEKLTVRACYLSMRRSLVAGKNPVGEALKVLLDMDEAGVRPERSDYERLVWACTRDEHYAIGKELYQRIRDGGDEISLSVCNHLIWLMGKAKKWWAALEIYEDLLDKGPKPNNLSHELIMSHFNVLLDAAKRRGIWRWGVRLLDKMQEKGLKPGGKEWNAVLLACSRASETSAAVDVFKKMMERGLKPDVVSYGALLSALEKGRLYDEALRVWEHMRRLGIEPNLYAYTILASIYIGKGDHAMADAVLHDMLSKRIAPTVVTFNAIISACARSGSGGNAFEWFHRMKTKGIEPNEITYQVLIEALVQDGKPRLAYEMYMKACGQGLQLPAKSYDTVLEACKAYGSVVDVATLGPRPSKGVEVEPIRIENSFSSLSQFKDVHGSSHRFAGVGMYGFYGYRMAR

SEQ ID NO: 96599 - DNA, 1422 bp, Zea mays
  misc_feature: Ceres CLONE 1700153
  misc_feature: Encodes the peptide sequence at SEQ ID NO. 96600
acttttgtttttggttgggaggccacaagctccaccacggggcacgggccaatcggcatcgtcgaaggcgttgcctcgccgctttctttaatgcttaagcgctcccgcggtggaggacgaatcaccacctctggccactttggcatctgccgatgcgtccactgctcccggccccccgctgcataaatacctcctctcgcggcccattcccacctccccctcctcgccgctccgggctgaccaagggctcgccgcctcccgtgtcctccgactccgacagggaaaggcgaaaccttgggtcggctcgctagtggagtgcagggtacgttgatgacggagctgtggatggaggtgctgccgccgccctacttcgcggggcaggcggcgggcgggtggttcctgccggaccggcgggccgggcccggggcgtggacgctggaggagaacaagatgttcgagcgcgcgctggcgagggtcgactgggacgcgccggaccggtgggagcgggtggccgcgttgctgcccggcaggacggcgtccgacgtcgcggcccactacgacgacctggagtgcgatgtcggctgcatcgaggcaggcttcgtgcccttcccctgctacggcagcggcggcggcgcgtcgcagtccgccgggttcacgttcgactgggacgccggcgggctgggctttaagcgctcctgctacgtggtcggcggcggcaagcgcgagcgcgggccggaccaggagcgcaagaagggcgtcccctggacggaggaagagcacaagcagttcttgatgggcctgaagaagtacgggcaaggggactggaggaacatctcgcgcaacttcgtgacgagccggacgccgacgcaggtggccagccacgcgcagaagtacttcatccgcctcaactccggcggcaaggacaagcgccgctccagcatccacgacatcaccaccgtcaacctccccgacgacgacgcgggcggcaccgcctccgcctcgccgccctccgtgctcacctccgcctccgcgccctcgttcaccggcggcggcggcccggtcgtctccgagcagttcggcgtgctcgtcgacagcaagcccccggcgccgcaccaccacttcgtgccgcacccgtacggcaacgtgaagctcgagcccgtcagttcccaccacggcgggttcctggacgactctgtcctgatgcagatgcactgcgggcagctgcagcctctcggatgactggttgtttgtgcagcaacaatggtagaaagagggaaatgcctctcgtctctttggccagttacgaggggtggagggtaccataccgctctgttgcgttgcgcgtgtctgttgttggatttcaatcaggcaaataacatttgggtacagcacaaaaaaaaaaaagaaaaaaaaaaaaaaaaa

SEQ ID NO: 96600 - protein, 302 aa, Zea mays
  misc_feature: Ceres CLONE 1700153
  misc_feature (142)..(189): Pfam Name: Myb_DNA-binding Pfam Description: Myb-like DNA-binding domain
  misc_feature (31)..(80): Pfam Name: Myb_DNA-binding Pfam Description: Myb-like DNA-binding domain
  misc_feature: The sequence is a functional homolog of SEQ ID NO 1897 in the 11/479,226 US patent application
  misc_feature: The sequence is a functional homolog of SEQ ID NO 120 in the 11/375,241 US patent application
  misc_feature: The sequence is a functional homolog of SEQ ID NO 2680 in the 10/374,780 US patent application
  misc_feature: The sequence is a functional homolog of SEQ ID NO 654 in the 10/225,066 US patent application
  misc_feature: The sequence is a functional homolog of SEQ ID NO 22 in the 10/225,066 US patent application
  misc_feature: The sequence is a functional homolog of SEQ ID NO 2870 in the 10/374,780 US patent application
  misc_feature: The sequence is a functional homolog of SEQ ID NO 886 in the 11/435,388 US patent application
  misc_feature: The sequence is a functional homolog of SEQ ID NO 1930 in the 10/412,699 US patent application
  misc_feature: The sequence is a functional homolog of SEQ ID NO 246 in the 10/714,887 US patent application
  misc_feature: The sequence is a functional homolog of SEQ ID NO 246 in the 11/435,388 US patent application
  misc_feature: The sequence is a functional homolog of SEQ ID NO 452 in the 10/374,780 US patent application
  misc_feature: The sequence is a functional homolog of SEQ ID NO 88 in the 10/225,068 US patent application
  misc_feature: The sequence is a functional homolog of SEQ ID NO 984 in the 10/225,066 US patent application
  misc_feature: The sequence is a functional homolog of SEQ ID NO 1000 in the 10/225,066 US patent application
  misc_feature: The sequence is a functional homolog of SEQ ID NO 1885 in the 11/479,226 US patent application
  misc_feature: The sequence is a functional homolog of SEQ ID NO 274 in the 10/714,887 US patent application
  misc_feature: The sequence is a functional homolog of SEQ ID NO 274 in the 11/435,388 US patent application
  misc_feature: The sequence is a functional homolog of SEQ ID NO 306 in the 10/374,780 US patent application
  misc_feature: The sequence is a functional homolog of SEQ ID NO 50 in the 10/286,264 US patent application
  misc_feature: The sequence is a functional homolog of SEQ ID NO 928 in the 10/412,699 US patent application
MTELWMEVLPPPYFAGQAAGGWFLPDRRAGPGAWTLEENKMFERALARVDWDAPDRWERVAALLPGRTASDVAAHYDDLECDVGCIEAGFVPFPCYGSGGGASQSAGFTFDWDAGGLGFKRSCYVVGGGKRERGPDQERKKGVPWTEEEHKQFLMGLKKYGQGDWRNISRNFVTSRTPTQVASHAQKYFIRLNSGGKDKRRSSIHDITTVNLPDDDAGGTASASPPSVLTSASAPSFTGGGGPVVSEQFGVLVDSKPPAPHHHFVPHPYGNVKLEPVSSHHGGFLDDSVLMQMHCGQLQPLG

SEQ ID NO: 96601 - DNA, 586 bp, Zea mays
  misc_feature: Ceres CLONE 1700411
  misc_feature: Encodes the peptide sequence at SEQ ID NO. 96602
  misc_feature (548)..(548): n is a, c, t, g, unknown, or other
gctctctgctcccctctccatttttcatctcattcggcgccgcggcaccccctgctcgtcactcgcgatggcccggatcaaggtgcacgagctgcgcggaaagagcaagacggatctgcaagcgcagctcaaggagcttaaatcggagctctccctcctacgcatcgccaaggtcaccggcggggctcccaacaagctctccaaaatcaagatcgtgcgcacctccatcgctcgcgtgctcaccgtcatctcgcagaagcagaagtcggcgctgcgtgaggcgtacaagaagaagaagcttctcccgctcgatctccgccccaagaagacccgcgccattcgcaggcgcctcaccaagtaccagctctccttgaagactgagagggaaaagaagcgtgagaagtattttcccatgcggaagtacgctatcaaggcctagattagtgaaagaacagcttttatcctatcaagttctgcccagaagtttcttgagtttgatgtaccgcacatctatcgtcattacaatggaatgatgaaaacgaatatgntttcgggcttctactcataaaaaaaaaaaaaaaaaaaa

SEQ ID NO: 96602 - protein, 123 aa, Zea mays
  misc_feature: Ceres CLONE 1700411
  misc_feature (6)..(64): Pfam Name: Ribosomal_L29 Pfam Description: Ribosomal L29 protein
MARIKVHELRGKSKTDLQAQLKELKSELSLLRIAKVTGGAPNKLSKIKIVRTSIARVLTVISQKQKSALREAYKKKKLLPLDLRPKKTRAIRRRLTKYQLSLKTEREKKREKYFPMRKYAIKA

SEQ ID NO: 96603 - DNA, 611 bp, Zea mays
  misc_feature: Ceres CLONE 1701645
  misc_feature: Encodes the peptide sequence at SEQ ID NO. 96604
gtactcgagctacttcacaagcctcgatggcatgctacgggatgaatgaagccatgaagaagaagaagaagatgcatgattaagaaaggcgatcgaagagctcccttcgatccaatccaggaggggaagtggtcggttgcagctgccggttcatggatacctctctggtgcagcaatggccgctgctcacctctgcacttgcatgggtgtgcatgacccgggagatgagcccgccatcatctttccctcgtgcttggattgaagggagctcctctctgtctgtctgtctgtctctctctctccctttccttcccgtggcggtctactgataatttctcgtcatttctatctcttacttgcagttgcattgcagacacggatatgcatgctattgcctcccaagcgccgggaaactttaatctggataattggattcatgcataaatgaaccagtatgtatatatatacgtgtgtatcacgtttcaggacaagcctgatgtacaattttgctctatctttttactgtttcaataacttttacagattgttcgtttcaattaaataaataattatataaaacagttttgcacaaaaaaaaaaaaaaaaaaaac

SEQ ID NO: 96604 - protein, 58 aa, Zea mays
  misc_feature: Ceres CLONE 1701645
MDTSLVQQWPLLTSALAWVCMTREMSPPSSFPRAWIEGSSSLSVCLSLSLPFLPVAVY

SEQ ID NO: 96605 - DNA, 708 bp, Zea mays
  misc_feature: Ceres CLONE 1703606
  misc_feature: Encodes the peptide sequence at SEQ ID NO. 96606
aacgccaacatatatcaccatatctgtttgtctcccttcccttcccttggatccatacacaggagccgaggaggacggcggcggcgtcgagaagagatggccgacggcagcagcaactcatcggcgtcggtggccatggaacaggaggtgcaggctttcgttgagaacaagtatggtggaatggtgcctaagaagcctctgatttcaaaggatcaggagcgcgcctattttgattctgcagactgggtccttggcaagcaagctgcaaacagcggcaccgcacgggctgcgactgctatcgaattcttgaagccaaagctaaagaggacgccccatcaccagcttccccctcgcaagccgacctgtgcgtccagctgagctcaagacagtgcgaaaatccaaagggccaggcttacaaaagctccctggctgggagagacgatgaagagcgttatcaagttttttttagttggttgcattggttaggaaggcaaattcaggattgatgagccctgcatttggctttgttcgcagcactcgctgaattattaatttaagcatgtgggggacatagataaaactagactcctgctattatatgcttaattgtggaagtggtagatgacacccatctgtttcaatgtatctttggttggcagatgaaatgtatcctctctatctacttggcttcaaaaaaaaaaaaaaaaa

SEQ ID NO: 96606 - protein, 93 aa, Zea mays
  misc_feature: Ceres CLONE 1703606
  misc_feature (23)..(94): Pfam Name: Lg106 Pfam Description: Lg106-like protein
MADGSSNSSASVAMEQEVQAFVENKYGGMVPKKPLISKDQERAYFDSADWVLGKQAANSGTARAATAIEFLKPKLKRTPHHQLPPRKPTCASS

SEQ ID NO: 96607 - DNA, 615 bp, Zea mays
  misc_feature: Ceres CLONE 1703773
  misc_feature: Encodes the peptide sequence at SEQ ID NO. 96608
aatccagatagagttccacgtacgtagcagtgatccattcccacgtacgttccagaagaatctgcagcagggagggacgagcagctagctagccatccatccaaatgggccgttggttgaagccagatgtgtacccgctgatcgcggccatgtcgttcgtgacggggatgtgcgtgttccagctggcccggaacgtgctgatgaacccggacgtgcgggtgagcaagaccagccggcagagcgccgtgctggacaacgccggcgagggccagcgctacagccagcacgccttccgccgcttcctcgccacgcagcgcccggaggtcttccccgccctcaacagcttcttctccgactccaataataataacacccccgccgacaagtgacctctactgataaattcatctcatccacggtctggtggtcttattactcttacgccgcgcgccggccggcgacgacggcgcccgcgtgtctgtaatcatgccacatatatatagtgtacatgtgccggtcgaataaaagttgagtctcttttagtccttccaaaaaaaaaaaaaaaaaaaaaaaaaaaaaaaaaaaaaaaaaaaaaaaattaaaaaaaaaaaaaaa

SEQ ID NO: 96608 - protein, 94 aa, Zea mays
  misc_feature: Ceres CLONE 1703773
  misc_feature (1)..(87): Pfam Name: B12D Pfam Description: B12D protein
MGRWLKPDVYPLIAAMSFVTGMCVFQLARNVLMNPDVRVSKTSRQSAVLDNAGEGQRYSQHAFRRFLATQRPEVFPALNSFFSDSNNNNTPADK

SEQ ID NO: 96609 - DNA, 603 bp, Zea mays
  misc_feature: Ceres CLONE 1703794
  misc_feature: Encodes the peptide sequence at SEQ ID NO. 96610
aacctctctctcccagtcccagtctgtagtgcactcaattcatcatcctcctcctcagtagccatcgattctaacctcacccgcgccgcatctgccaagctcctccgctcctgttactcccatggagctcgcagcgtccgcttccgcctcggccgtctgctcggcgtaccgccaactctcggcgccagcggcggccgctgaccgcggcgtcggcggcgacgacgcgcaggagacggcgacgcggctcgatcggcggcggaggaagcgcggcggcggctgcgcggggctccggcggcggtgctacgcggtgctcaagcagcagcggacgcggctctacatcctccgccggtgcgtcaccatgctgctgtgctggcaccagcacgacctgtccgactgagcgcgctcgatctgtttccttgtgtagtgtgtgtacggtcctagggagaggatagggagggagacgaagcttttcgttgcgaccggctgccggcatgtgaaaatcatcgaatgctggtggaatctggtttccaatttggcgtgtatttgggcatgaacaacgcgaacaaatttatattgcctgatttgtaaaaaaaaaaaaaaaaa

SEQ ID NO: 96610 - protein, 91 aa, Zea mays
  misc_feature: Ceres CLONE 1703794
  misc_feature (65)..(83): Pfam Name: DVL Pfam Description: DVL family
MELAASASASAVCSAYRQLSAPAAAADRGVGGDDAQETATRLDRRRRKRGGGCAGLRRRCYAVLKQQRTRLYILRRCVTMLLCWHQHDLSD

SEQ ID NO: 96611 - DNA, 737 bp, Zea mays
  misc_feature: Ceres CLONE 1703817
  misc_feature: Encodes the peptide sequence at SEQ ID NO. 96612
aattggcatagcatctatatccaccagcatgcacgcgtctcctatccatgttcgtcgacgacacgcgagcatggacagcatggtctgcgtcattcatctggtgctcgctgtttcgctcgcactggccggccccatcatcgccggcggcagcacggaggaggttgggctagcccgcaagcaggccgacgaggcgtatgccgcacggcagatgacggctcaagcgacgacgacggcgtcgacgatgggaaaggaggtgcaccgccgcgtcctcggcagcatcaatccgtccacactcgatcctgacaagccagcctgcctcggatcgtgcccagctgccggtagaccgtacaccggccgcggctgccagaaggcgtaccagtgctctggctgaacacccacggacacatgcgtcgttcgtccctactccaatcaggcatcctgtccagtgcattcgattttttattttgtcattgtttttaattaccatccttatagagccaacgcatgatgtgtaccgttgctgtaaactggaccagcgctacttgtccaaaacctaaacaccattggttattgacattgttctgttgcaaatgggcttcctaagctccttgaaatgtacggtgtcgaatcattaaaccaaacagattaggacagcaaatgaacaaggaaaggtcaggacgatcaaaaaaaaaaaaaaaaaaaaaaaaaaaaaaaaaaacaagaaaaaaaaaaaaaaa

SEQ ID NO: 96612 - protein, 120 aa, Zea mays
  misc_feature: Ceres CLONE 1703817
MHASPIHVRRRHASMDSMVCVIHLVLAVSLALAGPIIAGGSTEEVGLARKQADEAYAARQMTAQATTTASTMGKEVHRRVLGSINPSTLDPDKPACLGSCPAAGRPYTGRGCQKAYQCSG

SEQ ID NO: 96613 - DNA, 913 bp, Zea mays
  misc_feature: Ceres CLONE 1703845
  misc_feature: Encodes the peptide sequence at SEQ ID NO. 96614
actggctactaccaggatgacctctgcttcattactacctgttgggaaggaatagccgtcagaagaagcaggaatagccggtggcatggcaatggcgggtcggcaacgtgcgcctgaagcagcttcttcatatttgccgccagtgacggcagcggctttgtttctatgggtctttattagctgtgcacatgtggaggcaagcgttgattttgccaacctgactgctcttcagaagcatgctgaattcttcgaccggaataaggatggtattattacagcctcagagctctttgaaggatacgttgcaattggatgcgatgccgaatatgccagggttacatccgcatccatcagtgctggtgttggtcctataacaagccctgctgatgcaccactgcctcacacatccatatacgtagaatatatccatagggcgatgcatggaagtgatacgggtgcatacgacgctgatggaaggtttgttcctgcaaagtttgaagaaatattcacgaagcatgcgaaggtcaggccggatgcgttgacgtccgaggagattgaggagatgattctagcaaatagagacccattggaccctgaatcatgggctgcgcctgaaggagaatggggactaacatacaagcttgcaagtgataagcaaggctttcttcacaaggactctgcaagaggcatatatgatggcagtgtgttctacaagctggaggaacagaggacgtctgcagcaagcgaaatgtgatggagttcagcattcagccagatgcaaccagcatatataataaacacgaaaatgtgttaggaaattactagactgttatgtgaatcgggttttattggttgctggctccgctcccgcccagattacgccagcctgggccggtaaaaaaaaaaaaaaaaa

SEQ ID NO: 96614 - protein, 222 aa, Zea mays
  misc_feature: Ceres CLONE 1703845
  misc_feature (40)..(213): Pfam Name: Caleosin Pfam Description: Caleosin related protein
MAMAGRQRAPEAASSYLPPVTAAALFLWVFISCAHVEASVDFANLTALQKHAEFFDRNKDGIITASELFEGYVAIGCDAEYARVTSASISAGVGPITSPADAPLPHTSIYVEYIHRAMHGSDTGAYDADGRFVPAKFEEIFTKHAKVRPDALTSEEIEEMILANRDPLDPESWAAPEGEWGLTYKLASDKQGFLHKDSARGIYDGSVFYKLEEQRTSAASEM

SEQ ID NO: 96615 - DNA, 531 bp, Zea mays
  misc_feature: Ceres CLONE 1704124
  misc_feature: Encodes the peptide sequence at SEQ ID NO. 96616
acagacccgccgcctctacgcctttcagtatccggaagaccggaagcttcttcctcctcgcctctgacatggccggcggcaacctattcggtcgagcgctgagctacgttgtcaacgagctcttcgtccagggcctcgccaacaaccgtgcagtccagaggtttgctgtgaagaccaacaagactcttgagagcctatcgtctaaagccgaggaaatgagggaggagttatcggaacaattcaaggatgctcgtggccagaaagatcacttcaagcagtgaagccgatccccaaagttgattcaacgacacgaatctagctatgagttttttctagttctcgtccgggtcctatttatgaatggcatttgaagggatttcttggtgtcgttcaatggacggatccgttgtataaagtttatctgcacttagattagtagatatattggtagacacatcactttctgctgcccctttttcataaatacatatatctcgatctctactgtacccaaaaaaaaaaaaaaaaaaa

SEQ ID NO: 96616 - protein, 70 aa, Zea mays
  misc_feature: Ceres CLONE 1704124
MAGGNLFGRALSYVVNELFVQGLANNRAVQRFAVKTNKTLESLSSKAEEMREELSEQFKDARGQKDHFKQ

SEQ ID NO: 96617 - DNA, 521 bp, Zea mays
  misc_feature: Ceres CLONE 1704432
  misc_feature: Encodes the peptide sequence at SEQ ID NO. 96618
acatagaaagcagtagcagcaagcaagcaatggagatagaatcggtcaagtgcgagtgctgtggcctgaaggaggactgcaccccgcactacattgccagcgtgagatcaggcttccatggccaatggttgtgtgggctgtgctgtgaggcggtcagagatgaagcatgcaggaggaaggctcacccaggagtagaggaggctgtgagggctcacatggcgttctgcaacatgttcaagttgaaccccgccgtccgcgtggccgacggcatgcgccagatgctccggaggcggtcaggtgatatgtcaaagccagaatcagccaagaagtacgaatcatcagcgacactgtattgaagagttcatccatcctaaggcctgtagaccgtgtagccctcttctcaggctgaaatcccttccactttttgtcactttgtcagtttgctgtatgttcttcttatcatgcctatgccttcttggaatgtacatacgattcatgcgtaaaaaaaaaaaaaaaaaaaa

SEQ ID NO: 96618 - protein, 108 aa, Zea mays
  misc_feature: Ceres CLONE 1704432
  misc_feature (3)..(107): Pfam Name: DUF1677 Pfam Description: Protein of unknown function (DUF1677)
MEIESVKCECCGLKEDCTPHYIASVRSGFHGQWLCGLCCEAVRDEACRRKAHPGVEEAVRAHMAFCNMFKLNPAVRVADGMRQMLRRRSGDMSKPESAKKYESSATLY

SEQ ID NO: 96619 - DNA, 485 bp, Zea mays
  misc_feature: Ceres CLONE 1705111
  misc_feature: Encodes the peptide sequence at SEQ ID NO. 96620
atacctccatgcacggctgacggcccttcccgcttcccctcggccggtggttccaagttttgatttgagtgttaggacaagatggtggccaatggtgatgcacctgctagagggagcgcggcggcagccgcaagcctgcgtaggcgtaggaccacaagcggtgctgctgctggtggaggcggtgccagctcaatgctccaattctacactgatgaggctgccggccgcaaaatgtcaccaaacactgttctgatcatgagtattgggttcgtagccgtcgttgctgtgctccatgtattcgggaagctgtaccgcacctccaactaggttggcattgccatatccaagaaagctgagtccaccaagagaggattcctgtagaacaatttaaatggatagcaagtgactaccagactctgttgtagaagtttatttatacaacttgcaatgctgcgaggctattcacaaaaaaaaaaaaaaaaaaa

SEQ ID NO: 96620 - protein, 81 aa, Zea mays; identical to SEQ ID NO: 71824
  misc_feature: Ceres CLONE 1705111
  misc_feature (32)..(77): Pfam Name: Sec61_beta Pfam Description: Sec61beta family

SEQ ID NO: 96621 - DNA, 632 bp, Zea mays
  misc_feature: Ceres CLONE 1706289
  misc_feature: Encodes the peptide sequence at SEQ ID NO. 96622
ggctggaaccgcagaagaggcggccaggccavgcattagcaaagcataccccaaaatctccaaaccctaggcgaactcggcacggcggcgatggcagcggcgggcctgcggaaggggaacgcgcgcctcccacccgaggtgaaccgggtgctgtacgtgcggaatctgccgttcaacatctcgagcgaggagatgtacgacatcttcggcaagtacggcgcgattcggcagatccggctgggcaacgccaaggacacgcgcggcaccgcctacgtcgtctacgaggacatatacgacgccaagaacgccgtcgaccacctctccggcttcaacgtcgccaaccgctatctcatcgtgctctactaccagcccgccaagatgtccaagaagtcggatgtcaagaagaaggaggacgagatcactaggctccaggagaagtacggaatagggtccaagacgcccggccctggctccaccgactgagcggccagagtattgcctctgaagcctctttgtatgatgaagagtaatcagagggaacaaactggtagcactgtgctgwgtttcatccagtgttgctaattactctgtgttgttattcggtcaattgaatatatatgtgcttaatgtga

SEQ ID NO: 96622 - protein, 130 aa, Zea mays
  misc_feature: Ceres CLONE 1706289
  misc_feature (21)..(89): Pfam Name: RRM_1 Pfam Description: RNA recognition motif. (a.k.a. RRM, RBD, or RNP domain)
MAAAGLRKGNARLPPEVNRVLYVRNLPFNISSEEMYDIFGKYGAIRQIRLGNAKDTRGTAYVVYEDIYDAKNAVDHLSGFNVANRYLIVLYYQPAKMSKKSDVKKKEDEITRLQEKYGIGSKTPGPGSTD

SEQ ID NO: 96623 - DNA, 485 bp, Zea mays
  misc_feature: Ceres CLONE 1706873
  misc_feature: Encodes the peptide sequence at SEQ ID NO. 96624
ggccgactgggactgagaagaaacctcccttcacctacctctctacgaactacctgccgccggaaaaccctagagcactcgaccatggatccgcagcagccggagcctgtcagttacctctgcggagattgcggagctgagaacaccctgaagcccggagatgtcatccagtggcgtgaatgtggctaccgcatcctctacaagaagcggacccgccggattgtccaatatgaagcgcgctgaagagtgaagacaagggaaaacactgaagatggttgatctattactcgccacattacctatgtaaacagtcttctgggggaaatgaaaatgtcagacttaacgtttgtatgtcgtgtgcctcctttgaacctgagctgtataatttgtaacgcttggactggggactgatttgagaactgagacactgcagcaatatgttgatgggtccttagtggcgaatacaaaaaaaaaaaaaaaaaaaa

SEQ ID NO: 96624 - protein, 52 aa, Zea mays
  misc_feature: Ceres CLONE 1706873
  misc_feature (11)..(42): Pfam Name: DNA_RNApol_7kD Pfam Description: DNA directed RNA polymerase, 7 kDa subunit
MDPQQPEPVSYLCGDCGAENTLKPGDVIQWRECGYRILYKKRTRRIVQYEAR

SEQ ID NO: 96625 - DNA, 1632 bp, Zea mays
  misc_feature: Ceres CLONE 1707451
  misc_feature: Encodes the peptide sequence at SEQ ID NO. 96626
aaccccaccctcccctcccatcgcgattcgcgaatcaccaaactacccctcgttgtgaaaggaaggagacgaacgaggcagcggaaaggggagaggatttttcagattttccggcagcgacctacctagcccagcccagcgagagagaccgagcgacagcagctaccttctcccgacatgacgccgcatctgcccgccgtctcctcctcctcctccacgacgaccacatcccgcgccgccgccgccgctgccgcgcctccgtcctcgccgcatcagtaccggaggcggaggcggcgccgggtgccgggctgcctccgcccgcgcgccgcgtccgtccgctgctgcgccgcggcggcgcccgcgccgcaggcagcggtgcccgcggccgcgcgggccgaggcaaccacgcgggtcttcgtcgtgtccgacctgcacacggactacccggagaacatggagtgggtgcgccgcctgcccgccgaggtcggggcgggcaagggggaaggcgtcgacgcgctcgtcgtcgcgggcgacgtggccgagacaagggacaacttcgcgcgcaccatggagatgctcagggatggattcgccgccgtcttctacgtgccggggaaccacgacctctggctgcgccgcgagggcggccgctacatggattcgctggagaaactgactgcattgcttgatgcgtgtagtgagctgggtgtggatacaggcccaagaacgataggtgacttgggaatcataccattgttctcatggtatcacaagagctttgacaaggagaaggatgttagcagtgtgcgtgttccgtcgctagaaatggcttgtaaagactttcatgcttgccaatggccttcagacctgacaaatgatgatgaggctcttgctctttactttgacaagttgaatgacaagaatcatgatgctactgaagaagtgaaaagtagcagcaaacagatattaacattttcacacttcgtaccaaggcaagagttgtgtccagagaaacgtatgctttattacccataccttcctaaggtaattggatctgattttttggaaaggaggctgagagatatacacagcaacagaaaagacggaggagcttgccatgtttttgggcacactcatttctgttgggattccgtggttgatgagatcaggtatgtgcaagcccctctggcatacccccgagaaagaaaacgtcggatgaacggcgaaggttggctgccattttgtgtataccgtgacggtttcaacccagaaatatatccggcattgtggtcagactactacaacaagaacaaaagggaacccgagaacactcagctcgcgccttgggttgccagccatttcgcgaggtaccacaagttccactgaccctttctaagttccctggctttttgccgaagtggatgcagttcgtctgttcaggatggtgttgaaacctgcatttacctgggaaaaggagatattgacgttttacctgtacacgatctttttcttgtttccactcttaccataacttttgggcaaagtaagcgctagcatctgttttgtactagtatgttgcacagatctgaataatgtgcataagattcttcaaagcaaaaaaaaaaaaaaaaa

SEQ ID NO: 96626 - protein, 402 aa, Zea mays
  misc_feature: Ceres CLONE 1707451
  misc_feature (77)..(322): Pfam Name: Metallophos Pfam Description: Calcineurin-like phosphoesterase
MTPHLPAVSSSSSTTTTSRAAAAAAAPPSSPHQYRRRRRRRVPGCLRPRAASVRCCAAAAPAPQAAVPAAARAEATTRVFVVSDLHTDYPENMEWVRRLPAEVGAGKGEGVDALVVAGDVAETRDNFARTMEMLRDGFAAVFYVPGNHDLWLRREGGRYMDSLEKLTALLDACSELGVDTGPRTIGDLGIIPLFSWYHKSFDKEKDVSSVRVPSLEMACKDFHACQWPSDLTNDDEALALYFDKLNDKNHDATEEVKSSSKQILTFSHFVPRQELCPEKRMLYYPYLPKVIGSDFLERRLRDIHSNRKDGGACHVFGHTHFCWDSVVDEIRYVQAPLAYPRERKRRMNGEGWLPFCVYRDGFNPEIYPALWSDYYNKNKREPENTQLAPWVASHFARYHKFH

SEQ ID NO: 96627 - DNA, 988 bp, Zea mays
  misc_feature: Ceres CLONE 1707478
  misc_feature: Encodes the peptide sequence at SEQ ID NO. 96628
aaaccagcaaacaaataccagtaccgctccactacttgattgccgcctcactggcaccgctggtccgctcccagttccagtgacactgcaccagaccacccggctccagcgagatccagacccaaaacctcacctcgcagccaacctctgctcggaggggaagggaagggaagcaatggcggccaacggaggcgggtaccgggcggaggacgactacgactacctcttcaaggtggtgctcatcggcgactccggcgtcggcaagtccaacctcctctcccgcttcaccaagaacgagttcagcctcgagtccaagtccaccatcggcgtcgagttcgccacacgcagtctccaggtcgacggcaaggtcatcaaggcccagatttgggacaccgccggccaggagaggtaccgtgcaatcacaagtgcctattaccgaggagccgtaggggcactgctggtctacgatgtcacccgtcgcaccacgttcgacaacgtgggccgttggctgagggagctcagagaccacaccgaccagagcatcgtggtgatgctggtcggcaacaagtccgatctccggcacctggtggccgtctcgaccgacgacgccaaggagttcgccgaggccgagtccatgtacttcatggagacgtccgccctcgacgccaccaacgtggacagctccttctcggaggtgctgacccagatataccagatcgtgagcaagaagacggtggaggtccccgaggagggggcggtcgccccgggcaagggggagaagataaacgtcaaggatgacgtttctgcgatgaagagggtcgggtgctgctcaaactaaggcgaatagccggatacgaatggtttgttcgattgtctttcggtgctgagggttagaggacggttgagactatcagcttaaattatttattatcagctccgaattcgtggttctgtcaaattcaatcatttttttgtgttcaaaaaaaaa

SEQ ID NO: 96628 - protein, 220 aa, Zea mays
  misc_feature: Ceres CLONE 1707478
  misc_feature (19)..(180): Pfam Name: Ras Pfam Description: Ras family
  misc_feature (19)..(133): Pfam Name: Miro Pfam Description: Miro-like protein
  misc_feature: SWISSPROT Homolog: EC 2.7.11.1 Non-specific serine/threonine protein kinase
MAANGGGYRAEDDYDYLFKVVLIGDSGVGKSNLLSRFTKNEFSLESKSTIGVEFATRSLQVDGKVIKAQIWDTAGQERYRAITSAYYRGAVGALLVYDVTRRTTFDNVGRWLRELRDHTDQSIVVMLVGNKSDLRHLVAVSTDDAKEFAEAESMYFMETSALDATNVDSSFSEVLTQIYQIVSKKTVEVPEEGAVAPGKGEKINVKDDVSAMKRVGCCSN

SEQ ID NO: 96629 - DNA, 1128 bp, Zea mays
  misc_feature: Ceres CLONE 1707861
  misc_feature: Encodes the peptide sequence at SEQ ID NO. 96630
aatgcttgagcaagctctgctggtggcttgctagctatttctatcgatccagcagctatagctatgcatgcatgcagcaatggcggacgatgagcagcggcaggcagcagcatatgcgtgcgtgccgccagggttcaggttccacccgacggaggaggagctggtggggtactacctcgccaggaaggtggcttcccagaagatcgacgacctcgacatcatcagggaggtggatctctacaggatcgagccatgggatctccaggtccaggagaggtgcggctactacggcggcggccaggatcaggaggagccgacggagtactacttcttcagctacaaggaccgcaagtacccgagcggcacgcgcaccaaccgcgccaccgccgccggcttctggaaggccacgggcagggacaagccggtgctctcctccagcagcagcggcgtcgtcatcggcatgcggaagacgctggtgttctaccgcggccgcgcgcccaacggccgcaagacggactggatcatccacgagtaccggctgcagagcaacgagcacgcccccgcgcaggaggaaggatgggtcgtctgccgcgccttccacaagcccatgcccaaccaccaccaccacatgatcaggcacgccgccgcttcctgctgctactactatcctgcccctgcgcctcccgccgccggtctgccgccgcataatggccacctgcacctccacagcccctccgcggagtcggcggtggattggaacctgctgagcagcctgctaccgcccgggcagctggatttcgtccatcacacgctgacaccgccgccggcttcttctccttcttcctgctccacgacgaccaccaccaccaccaccaggaacaataacaatgaatgatgcgtgacaagacatcttaatttttccagctagcaatccaagacgactgattattatatctactgttttaaccaaccacgcccacactacacactagctagcttacgtacgtagcgtatatatatattttgcattgtagggttactaggaactcatcatttcacgtgtacgagcttgagatctatctggaactgatatcagattgcttgatcatctaaaaaaaaaaaaaaaaa

SEQ ID NO: 96630 - protein, 275 aa, Zea mays
  misc_feature: Ceres CLONE 1707861
  misc_feature (19)..(159): Pfam Name: NAM Pfam Description: No apical meristem (NAM) protein
MHAAMADDEQRQAAAYACVPPGFRFHPTEEELVGYYLARKVASQKIDDLDIIREVDLYRIEPWDLQVQERCGYYGGGQDQEEPTEYYFFSYKDRKYPSGTRTNRATAAGFWKATGRDKPVLSSSSSGVVIGMRKTLVFYRGRAPNGRKTDWIIHEYRLQSNEHAPAQEEGWVVCRAFHKPMPNHHHHMIRHAAASCCYYYPAPAPPAAGLPPHNGHLHLHSPSAESAVDWNLLSSLLPPGQLDFVHHTLTPPPASSPSSCSTTTTTTTTRNNNNE

SEQ ID NO: 96631 - DNA, 985 bp, Zea mays
  misc_feature: Ceres CLONE 1707878
  misc_feature: Encodes the peptide sequence at SEQ ID NO. 96632
aatctatccaaccgcaccccagcgcatcgcaactcgatcgtcggagcaagcaaattaagctagcacccttccttccttccttccttcgcgaggcagctggcagggctagtatcaaccaaccgatacatatggctgagaggacaagcgggatggcggcgccgcggccgctcctgcgccggatgctctcgttccgggagccgctcctgctcctcccgtgcttgctcagcgtcctgggcgccgcggcctcggcgctgacccgcagccacgcgtcgctgctgcactcgctggccagatcgctcgtccggcccgcgcccgcagccgtcaacgacaacatgaagcacgccgccgccgcaacgcgcccggacgacggcgaggacgccgccgcggcgctgagcaaggcggaggtggaggcagtcatggcggcgatcgggctggcggcgtccgggcgcggcgagggcctggctgccgccgtgggccgcggcgacgtcgccgggctcttcgacgccgacgagcccagcttcgcggaggtgcggggcgccttcgcggtgttcgacgccgaccgcgacggattcatcggcgccgaggacctgcgcgccgccctggcgcgcctgggcgtgcggcaggacgccgccgcgtgccgcgccatggtcgtcgcggccggcggcggccgcgacgcccggatgagcctgttccagttcgtcgcgttcctcgagaacggcctgtgctgaggagaggactgactgtcccttcacttattttttttttcgtcgccttgggtgttcgttggtcgcctgtgttttttttccctcctgccatgagcccatgagttcgttgggggggcgtggatggtggtggactgtgcagcaattataacgcactaattcacaagttaggagcaatcaattagcggaactgattttcaccagttgcaacaaaatatactagtttcttatgaattaatttctaccaaaaaaaaaaaaaaaaa

SEQ ID NO: 96632 - protein, 199 aa, Zea mays
  misc_feature: Ceres CLONE 1707878
  misc_feature (133)..(161): Pfam Name: efhand Pfam Description: EF hand
MAERTSGMAAPRPLLRRMLSFREPLLLLPCLLSVLGAAASALTRSHASLLHSLARSLVRPAPAAVNDNMKHAAAATRPDDGEDAAAALSKAEVEAVMAAIGLAASGRGEGLAAAVGRGDVAGLFDADEPSFAEVRGAFAVFDADRDGFIGAEDLRAALARLGVRQDAAACRAMVVAAGGGRDARMSLFQFVAFLENGLC

SEQ ID NO: 96633 - DNA, 1405 bp, Zea mays
  misc_feature: Ceres CLONE 1707911
  misc_feature: Encodes the peptide sequence at SEQ ID NO. 96634
attcctcatccaaacaccacttcgctctgctccgacagtccgacttcgccgcgatcccgcaatggtcgacgtcgaccgccggccgtcgcacccgcacggcctcccgcgtcctccttcccacgccgccggcctgcgccgtctctccacccgtgcctcggcacccagcagcccggctcctccgtctccctccgcctccgcgccctccccgacggcgcttctcgctcacctcgccgcggccggagtggccgtcctcccgggcctctccgccaccgagttcgccctcgcggaggccgcgctcggcggcgtccagctgccgcccgacctccgcgagctcctcgcgctgggcctgccgtcgggggacggattcccggactaccgcaccccggcggggctgcgcctcctccgcttcgccgcgcaggaggtccccgcggccgtcgccgcgacgctgccgctcgccccgggccggcgcgcggggcgggccgcgccgccgcccctcgtcccgctgtgcggccggcattacgtgccggcgacgccctgcctcgcgggcaacccggtgttctacgtgtccgactcgggcgtcacgttcgcgggcgccaacgccgccgacttcctcctccgcgccttcgccgccgagccgccgcccggcgcgccgctccggcgccagctctccgcgccggtcccgcccccgtccggcgcgccgccgtccactgcgcgccggagcctggactccgtcaccggcagggccccgcgctggatcgagttctggacggacgccgccgcggccggggaccggttcctggaagtcccaacgggggccacaagcgccgccgcgtccagcgcggcgccggagtggctgcggcccagccttgaggaggcggcctcgatgctgaggcgcggcgggtggggcctctgcgaggtggaggagatggtgacgggagagggtcccagcggcgccggcgaggtgaatgtggtggcgttggcgttgactgtcgaccggtgctgccgggacctgaagagtggagggtggggcgcggaggaagtggtggagatgctgggggcgctgctggggccgaggaagccgcggcgggcggtggcggcgctgccgccggacgtggccgcacggatggggcggctcgccgaggccgtgtcgcgggctgtcgggtcccatgccaaggcgaaacctccgaggccatcttgagaaacagatgttgtagtctaggtcctaggaattcttttccccctgttttccctgtattgagtacgtgcgtgtacgtgtaagtgaactactagtcttgtacaacgagcagcacgtgccttgtatgtctgtaatgtacgtacatgttagatatgctagagtgaatgaataaatataaggactgtcatttcgcaaaaaaaaaaaaaaaaa

SEQ ID NO: 96634 - protein, 378 aa, Zea mays
  misc_feature: Ceres CLONE 1707911
MVDVDRRPSHPHGLPRPPSHAAGLRRLSTRASAPSSPAPPSPSASAPSPTALLAHLAAAGVAVLPGLSATEFALAEAALGGVQLPPDLRELLALGLPSGDGFPDYRTPAGLRLLRFAAQEVPAAVAATLPLAPGRRAGRAAPPPLVPLCGRHYVPATPCLAGNPVFYVSDSGVTFAGANAADFLLRAFAAEPPPGAPLRRQLSAPVPPPSGAPPSTARRSLDSVTGRAPRWIEFWTDAAAAGDRFLEVPTGATSAAASSAAPEWLRPSLEEAASMLRRGGWGLCEVEEMVTGEGPSGAGEVNVVALALTVDRCCRDLKSGGWGAEEVVEMLGALLGPRKPRRAVAALPPDVAARMGRLAEAVSRAVGSHAKAKPPRPS

SEQ ID NO: 96635 - DNA, 447 bp, Zea mays
  misc_feature: Ceres CLONE 1708147
  misc_feature: Encodes the peptide sequence at SEQ ID NO. 96636
attgttccagcgaacgcacacagccgccgctgtttcttcatcttcctcgctgccgccgcaccgccggcctcggctgacatcgccgtcgacatttgaacgcagggcgtcgtcgggtcgggcgtctgccagcgccgtccggctagccatcagtagctagtacgtagtaccagtatagtttgcagagtcgattgcgccatgtgtggtggctgcgtgcctgtgcctgccggcctggcctggagtgcggttctgctgccgccacagttaattggcccagtttgtctagctgtcgagtttttttttcaactctctctgtctctctccgactcttcccttctttttgataaagttcgtccctgcagttaaatctctgtttgctgcgacttgttcttcttgtgtgtgggagtgggacgaaatctcgtgtgtttacaaaaaaaaaaaaaaaaaaaa

SEQ ID NO: 96636 - protein, 55 aa, Zea mays
  misc_feature: Ceres CLONE 1708147
MCGGCVPVPAGLAWSAVLLPPQLIGPVCLAVEFFFQLSLSLSDSSLLFDKVRPCS

SEQ ID NO: 96637 - DNA, 509 bp, Zea mays
  misc_feature: Ceres CLONE 1708219
  misc_feature: Encodes the peptide sequence at SEQ ID NO. 96638
acgccgccactcacgaccacgccgcgcctttgaaaggaaccctttagccgagcggagcaaggaaagaaatggggaagggtacgggcagcttcggcaagcgccggaacaagacgcacacgctctgcatccgctgcggccgccgcagcttccacctccagaagagcacctgctcctcctgcggctaccccgccgcccgcatccgcaagtataactggagtgtgaaggccatcaggcgtaagacaactggtaccggaaggatgaggtacatgcgacacgtgcctcgccgtttcaagagcaacttcagagaagggactgaggctgccccaaattttttttttgctgctgccaactaagtgtggtcttgctaccatcaagaagcgctagaacttgagactttttgattgaattgtacttctgaactatttagcccataatactatgcttgaattaatttcagacgccctggagagggatatgtaaaaaaaaacaaaaaaaaaaaaaaaaaaaaa

SEQ ID NO: 96638 - protein, 94 aa, Zea mays
  misc_feature: Ceres CLONE 1708219
  misc_feature (2)..(55): Pfam Name: Ribosomal_L37e Pfam Description: Ribosomal protein L37e
MGKGTGSFGKRRNKTHTLCIRCGRRSFHLQKSTCSSCGYPAARIRKYNWSVKAIRRKTTGTGRMRYMRHVPRRFKSNFREGTEAAPNFFFAAAN

SEQ ID NO: 96639 - DNA, 615 bp, Zea mays
  misc_feature: Ceres CLONE 1708704
  misc_feature: Encodes the peptide sequence at SEQ ID NO. 96640
gctgacatctctctagctagctagctctctctctctctctgctccggcagggcttcacctcacctgtgccgctgtgtgcgtgcgtgcttatatgggttcttgggttcgcaccatcacaacgcccttcaggaaagcatgcaccatcttcggcccacagaaggacggcggcggcggcaagaggttgaagcaaccaaacccagcgaggatggtacggcacgtcgacgacgccgccgagagggccaagctgcacggggaggtgatggcgtgcgcctacgaagacgtgcaggtcatgtggtccatgctcgaccagacaacaaggattggggatctcagtggcagctcgtgaccgccggcaattgtttgtccattcatgcattttcctagagccacaaaggtggagatgcagacatggtgtacatagcaaaatatcttctcaccaaacattcccaaccccacttgctatcttgggccttgaattggaagagccatttgcgccgatcaattgagcccagaaccaagtacccgttttgtacgtagcaagatttattagcttttcttttggagtttccagctcagttgagaatttgaatcccctaaaaaaaaaaaaaaaaaaaa

SEQ ID NO: 96640 - protein, 84 aa, Zea mays
  misc_feature: Ceres CLONE 1708704
MGSWVRTITTPFRKACTIFGPQKDGGGGKRLKQPNPARMVRHVDDAAERAKLHGEVMACAYEDVQVMWSMLDQTTRIGDLSGSS

SEQ ID NO: 96641 - DNA, 529 bp, Zea mays
  misc_feature: Ceres CLONE 1709956
  misc_feature: Encodes the peptide sequence at SEQ ID NO. 96642
gtttcggttgcgtcaggtcagcctccctctccggatcccccacctgctccgccgccggccaacgcatcgctccccttggcagccaggatgacagaagcaccatttctgccacgtgagaggctcttcaagctgcaacatcatttccaggacatgaccaagcacacctacctgaaagggcgctacgatgtgatcacctccgttgccatccctcttgcacttgctgcctccagcatgttcatgatcgggcgtggagtttacaacatgtctcatggaattgggaaaaaggagtgatctaccacgggttaactagtttttctacttggcatggaagtaccatccagactatgaagtcttctttgcttgctaaataatactgtcaaatattttttttactcccccctcgcatcatatttctgtttgtataagaggataggaaatgccatcaacttgaagatcagcattgttactattttggttaattactccattcctgtcgctgttttgcgagaaaaaaaaaaaaaaaaaaaaa

SEQ ID NO: 96642 - protein, 67 aa, Zea mays
  misc_feature: Ceres CLONE 1709956
  misc_feature (9)..(62): Pfam Name: COX7a Pfam Description: Cytochrome c oxidase subunit VIIa
MTEAPFLPRERLFKLQHHFQDMTKHTYLKGRYDVITSVAIPLALAASSMFMIGRGVYNMSHGIGKKE

SEQ ID NO: 96643 - DNA, 485 bp, Zea mays
  misc_feature: Ceres CLONE 1710212
  misc_feature: Encodes the peptide sequence at SEQ ID NO. 96644
atataaggcccagcccaccgattctcctcttctgtcttctcccctgcgacaaagacgacgcaagtccctactcctccaaacccttgccgactcagatccagcttcctcgcaccgccgtcgccatgccgttcactccaggcccctactctggcgtcaacaccctcgcccttgtggcgagggcgtcggcctttggcgtcggtgtcgtctacgggagcatcaagctctcaatcctcaaggtaacaaaacctaaaaaggaggaagcgcatgatcatcaccaaggacgacaaggctgctacattttaattcccacatatggaaggatgttataaattggcagtgcaccccttctccatacgtacagtttcgtttatgatttgtggacctgtctgtaacatacctgctttttttttgtgttgtaataaattcttatacaatgacatgaaatcaggaagtggaaaagcaagtaaaaaaaaaaaaaaaaaaaa

SEQ ID NO: 96644 - protein, 68 aa, Zea mays
  misc_feature: Ceres CLONE 1710212
MPFTPGPYSGVNTLALVARASAFGVGVVYGSIKLSILKVTKPKKEEAHDHHQGRQGCYILIPTYGRML

SEQ ID NO: 96645 - DNA, 481 bp, Zea mays
  misc_feature: Ceres CLONE 1711560
  misc_feature: Encodes the peptide sequence at SEQ ID NO. 96646
cccaattcgcacggccatcggaccatggattccggcgtgcctgcctctgcctctgcctctgcctctgcgcctgcccctcccaaacacaagacatgccggaagtgcaaggcgagctatgacccctcggccaacacgcgcctctcctgcaggttccacccttccttcttcgtctgccgccgccacgacgaccagaagaggtactacgagctccgcgacggcgatcctccctacgccgccaagttctacgactgctgcggcgccgaggaccccgacgctcccggctgcaccactgacttgcaccgttcctacgacgacgcccaagactagcaaacctttgctgcttccacaggcctcatcttaatctcaagtctcatctaccgtttcgcttttgcatcccctccttatcctctctagtcagctatcaaattaaaccatctatgcacacttaaataaattttgccaaaaaaaaaaaaaaaaaaaa

SEQ ID NO: 96646 - protein, 100 aa, Zea mays
  misc_feature: Ceres CLONE 1711560
MDSGVPASASASASAPAPPKHKTCRKCKASYDPSANTRLSCRFHPSFFVCRRHDDQKRYYELRDGDPPYAAKFYDCCGAEDPDAPGCTTDLHRSYDDAQD

SEQ ID NO: 96647 - DNA, 1703 bp, Zea mays
  misc_feature: Ceres CLONE 1711705
  misc_feature: Encodes the peptide sequence at SEQ ID NO. 96648
agagccagctccgtctctctcgcgctcgctcctggtctcgtggccttgttccgtgcccagcccaattccagttccaggggtataggagcaggatctcctctcgcgaacaacccagtaaacaactccgcagcatgaggccaccgccacctccattgccgtccctgcgctcttccgccttggtcctcgtcctcctgctgctgctggccgcgtgctcgtccccggccagtgggagggccgtgccgtcgcctcctgagaccgcctccgttgctcccgcgccgcctcccgtcgtgatcatagtggagcggcgcaatcgtttccaccgggagctagtcgtcgcctccgccctcgcctccgtcgccatcgccgcgattatcctctccgcgctgtacgcgtgggtcctgtggcggcggtctcgccggctgccccgcggcaaaaagggcgccaggagcgcagacaccgcgagcgcgagggggatcatgatggcgccgatcctgagcaagttcaactcgctcaagacgagcaggaagggggttgtggcgatggcgatgatcgagtacccgtcgctggaggcggcgacggggaagttcagcgcgagcaacgtgctcggtgtcggcggcttcggttgcgtctacaaggcagttttcgatggcggtgtcgccgcggcggtcaagaggctggaagcaggcggccctgaatgcgagaaggaattcgagaatgagctggatttgctcggcaggattcggcaccccaacattgtgaccctgctgggcttttgtgttcacgaggggaatcactacattgtttatgagctcatgcacaagggatccctggacacacagctgcatggggcttcacgtggatcagccctgagctggcatgtccggatgaagatcgcactcgacatggccagggggttagagtatctccatgagcactgcagtccaccagtgatccatagggatctgaagtcatctaacatacttttagattctgacttcaatgctaagatttcagattttggtctcgcggtgaccagtgggaatattgacaagggaagcatgaagctttctgggactttaggttacgtggctccagagtacctattagatgggaagctgactgaaaaaagcgatgtatacgcatttggagtcgtgcttcttgagctactaatgggaaggaagcctgtcgagaagatgagtcaaactcagtgccaatcaattgtgacatgggccatgccgcagctgactgacagaacgaaactccccaacatagttgacccagtgatcagggacacgatggacccaaagcatctgtaccaagtggcagcagtggcggttctctgtgtgcaaccagaaccaagttacaggccgctgattactgatgttctccactcccttgtccctttagtgcccgtggagctcggagggacgttgagggtcgcagagccaccttccccaaacctaaaacattctgcttgttgagatgtcatggtcggtcgaagatgacagttacgtgctgatgaacttaggaagatgtttatcagtaacttatcactctagctgtgtgccagaggatgacggttccaacctgccggtcgctgagaattctggtttgcaaagagttgtctcctatgtctttgcttgtacaaagaagtgaaagaaacaacacccttagaatttagggtccaaaaaaaaaaaaaaaaa

SEQ ID NO: 96648 - protein, 449 aa, Zea mays
  misc_feature: Ceres CLONE 1711705
  misc_feature (152)..(422): Pfam Name: Pkinase_Tyr Pfam Description: Protein tyrosine kinase
  misc_feature: SWISSPROT Homolog: EC 2.7.11.1 Non-specific serine/threonine protein kinase
MRPPPPPLPSLRSSALVLVLLLLLAACSSPASGRAVPSPPETASVAPAPPPVVIIVERRNRFHRELVVASALASVAIAAIILSALYAWVLWRRSRRLPRGKKGARSADTASARGIMMAPILSKFNSLKTSRKGVVAMAMIEYPSLEAATGKFSASNVLGVGGFGCVYKAVFDGGVAAAVKRLEAGGPECEKEFENELDLLGRIRHPNIVTLLGFCVHEGNHYIVYELMHKGSLDTQLHGASRGSALSWHVRMKIALDMARGLEYLHEHCSPPVIHRDLKSSNILLDSDFNAKISDFGLAVTSGNIDKGSMKLSGTLGYVAPEYLLDGKLTEKSDVYAFGVVLLELLMGRKPVEKMSQTQCQSIVTWAMPQLTDRTKLPNIVDPVIRDTMDPKHLYQVAAVAVLCVQPEPSYRPLITDVLHSLVPLVPVELGGTLRVAEPPSPNLKHSAC

SEQ ID NO: 96649 - DNA, 1051 bp, Zea mays
  misc_feature: Ceres CLONE 1711731
  misc_feature: Encodes the peptide sequence at SEQ ID NO. 96650
aaaaaatgatgctccgatatattggctcgcgtaacgcggccccgcccccttttttatctcaacgacccttcccttaccttcccatcccccatttcctcaacggaccccgcccgcgatttcactccttctctcccccgcgcgcgcggcctccccgtgcccgtgcgtgcgccaacaccgcgcagccacgccacgcccgtcgaaagccccaagcacccggccagcacgcgcagtaggccgctgaggcacagagccggcggccggcgcctcggccatgcggcgatcagagtgggaggaccggtgcaagcggcacccggagcaccggacgtccaagggcgtgtgcccctactgcctccgcgaccgcctcgcgcacctctccgcgtcctcctcggcgaccaccaccacgcgcgcgtcctcgtcctcggcgcccacgtccccgtgctcctccggcggctcgtccccgccgccccagtaccgcgccgcgctctccgcggacgtcagctccgtccacgtcgtcgttgccgggtcctccttcgccgacgtcgccgccttctcccagccgctcatgccgacctccgccaacaagaagccgccgcccgcgagccaggacgagccggccagggggaagggcgaggcgaagaggaggaagagcggcaagaagaagaagatcgggaggttcctgtccaggctcgtcggcgcggagaggcggcggcacaccggcgacggcgacggcgccgagctcttccactccaaaaccatgaaggagaagacggcgtccaagtgggtgttcttctgaatcccctcgtcagatcagatgccagcaccatgctgcacacacacgcgcgcttgagggccggtttcctcgatcggtcggtatggagttttttccccccacttcaagtactcctgtgcttcaatccgctgcagttagttagcatggtttctctttccgactgtgtacacgagacaagccaaaactatggatcattataaggttatttgagaaatattgtatgcttattttgtaaaattagaggaaaaaaaaaaaaaaaaa

SEQ ID NO: 96650 - protein, 173 aa, Zea mays
  misc_feature: Ceres CLONE 1711731
MRRSEWEDRCKRHPEHRTSKGVCPYCLRDRLAHLSASSSATTTTRASSSSAPTSPCSSGGSSPPPQYRAALSADVSSVHVVVAGSSFADVAAFSQPLMPTSANKKPPPASQDEPARGKGEAKRRKSGKKKKIGRFLSRLVGAERRRHTGDGDGAELFHSKTMKEKTASKWVFF

SEQ ID NO: 96651 - DNA, 1539 bp, Zea mays
  misc_feature: Ceres CLONE 1712009
  misc_feature: Encodes the peptide sequence at SEQ ID NO. 96652
agccctcctctccagtccctcctccctccggtccgcacaggggagcagccggcagcagctagctaccacagtaccagcagcaataagctaatcagctacgatggcggactacgtgtatggccccgggcggacccacctgttcgtgccgggccccgtgaacatcccggaccccgtgatccgcgccatgaaccggcagaacgaggactaccgctcgccggcggtgccggcgctgaccaaggtcctgctggaggacgttaagaagatcttcaagaccacgacgggcacgcccttcatgatcccgacgacggggacgggcgcgtgggagagcgcgctgaccaacacgctgtccccgggcgacagggtcgtgtccttcctcatcgggcagttcagcctgctgtggatcgaccagcagcggcgcctgggcttcgacgtggacgcggtggagagcgagtggggccagggcgccgacctggccgcgctggagcgcaggctccgcgaggacgcgccgcggcacgccatcaaggccgtggccatcgtgcacaacgagacggccacgggcgtcaccaacgacctggccgccgtgcgcgcgctgctggacaagcacgcgcacccggcgctgctgctggtggacggcgtgtcgtccatctgcgcgctggacttccgcatggacgagtggggcgtggacgtggcgctcacgggctcgcagaaggcgctgtcgatgccgacggggatgggcatcgtgtgcgccagccccagggcgctggaggccagcaagacggccaggtccgtgcgcgtcttcttcgactggaaggactacctcaggttctacgacatgggcacgtactggccctacacgccctccatccagctcctctacggcctccgcaccgcgctcgacctcatcttcgaggaagggctggacaacgtcgtgaggaggcacaaccgccttgggacagccaccaggctcgccgtcgaggcgtgggggctcagcaactgctgccagaaggaggagtggttcagcgacaccgtcaccgccgccgtcgtgccgcccaacatcgacagcgccgaggtcgtcaggcacgcgtggaagcggtacaacctcagtctcggcctcggcctcaacaaggtcgccgggaaggtcttcaggatcggccatctcggcaacctcaacgagctgcaacttctgggatgtctgagcggtgtggagatggtgctcaaggatgtggggtacccagtgaaactaggtagcggcgtggcagccgcggcggcgtacctgtcaaactccacgccgctcatcccatctaggatctgagaacaatgtaaggggaggatatcgcaaacaaggccagcgacaacgagtgggcagacgaacgaacaaagcgttgctacatagtactctctcagaatgtaaagttaaatttcacacccagctgttgctacatagtagtatagttttatgaattacaggtttgattaaacttcaaattaatctacatgtatagccctgcccagatttaactgaaaaaaaaaaaaaaaaaa

SEQ ID NO: 96652 - protein, 403 aa, Zea mays
  misc_feature: Ceres CLONE 1712009
  misc_feature (11)..(362): Pfam Name: Aminotran_5 Pfam Description: Aminotransferase class-V
  misc_feature: SWISSPROT Homolog: EC 2.6.1.45 Serine--glyoxylate transaminase
MADYVYGPGRTHLFVPGPVNIPDPVIRAMNRQNEDYRSPAVPALTKVLLEDVKKIFKTTTGTPFMIPTTGTGAWESALTNTLSPGDRVVSFLIGQFSLLWIDQQRRLGFDVDAVESEWGQGADLAALERRLREDAPRHAIKAVAIVHNETATGVTNDLAAVRALLDKHAHPALLLVDGVSSICALDFRMDEWGVDVALTGSQKALSMPTGMGIVCASPRALEASKTARSVRVFFDWKDYLRFYDMGTYWPYTPSIQLLYGLRTALDLIFEEGLDNVVRRHNRLGTATRLAVEAWGLSNCCQKEEWFSDTVTAAVVPPNIDSAEVVRHAWKRYNLSLGLGLNKVAGKVFRIGHLGNLNELQLLGCLSGVEMVLKDVGYPVKLGSGVAAAAAYLSNSTPLIPSRI

SEQ ID NO: 96653 - DNA, 933 bp, Zea mays
  misc_feature: Ceres CLONE 1712012
  misc_feature: Encodes the peptide sequence at SEQ ID NO. 96654
aaaactccctctctcccagtccccagtccccacccaccaccagtcttcctcgctctccaaatctcgcgacgagaaagcccatctaggaccacaggggcgcgccagccggcaggaacgacgggagaggagggcatggagccggctgagcggatcgagtccgggacggcgctggggaagcgtccgaggagcagggtgctgccgcgcacggccagcatggtgacggtgccgtcggcggcgaagcaggggcgccaggagcggggcgccggcgtgccgtcgtcctgctcactgccggctgcctgcgccgggatgggggccgtgccggggggttactactactactgtggcggcccgttcgcggcggtggagacggcggccttcctcaaggcgtgcggcctctgcaaacgccacctcgggcccggccacgacaccttcatctacaggggcgaggtggcattctgcagccaggagtgccgggagaagcagatcgagtacgacgacctcgacgagcgcatggagcagacctgctccgtgacctccatgaaggaggccccgtccgtgtccggcgccagcggctccgaccagtccggcagcggcggggagaccgtggccgccgcctaggagcccccgggggcggggtggcgcaagggggcgggcgtggtgtgtgttgttgcgcaatggtggagcgggagcagcgacgcccggccgatcggtcggcccggcccggtagattccgccatgctagagcgcctgtgcatacagcttttagctctggattccggcagtgatgcatgcgtcagtgatttattattattatagctggttgatgcatgtgactctggaaacatggccccacttgtctgtcgaaacaaacaaacaaagagagagagaaagaggcaggtgtacccgggttgcaactaaaaaaaaaaaaaaaaa

SEQ ID NO: 96654 - protein, 161 aa, Zea mays
  misc_feature: Ceres CLONE 1712012
  misc_feature (73)..(125): Pfam Name: DUF581 Pfam Description: Protein of unknown function (DUF581)
MEPAERIESGTALGKRPRSRVLPRTASMVTVPSAAKQGRQERGAGVPSSCSLPAACAGMGAVPGGYYYYCGGPFAAVETAAFLKACGLCKRHLGPGHDTFIYRGEVAFCSQECREKQIEYDDLDERMEQTCSVTSMKEAPSVSGASGSDQSGSGGETVAAA

SEQ ID NO: 96655 - DNA, 1316 bp, Zea mays
  misc_feature: Ceres CLONE 1712025
  misc_feature: Encodes the peptide sequence at SEQ ID NO. 96656
aaaaaaaaaaaaaaaaaaaatcccctcaactctataactcggtcaccacacctcgctcgaaaacaaaactgatcaacagcattgttggtgacgatgagctcgacgtggctagcgtttgcatgggcggcgtccgccctcgtcgtggcggcgtccacggcccacgccccgcaccacccgtcgtcgctgcaggtcggtttctacaagcactcgtgcccacaggccgaggacatcgtgcgcaacgccgtccgccgcggcctggcccgcgacccgggcatcggcgcgggactcatccggatgcacttccacgactgcttcgtccggggctgcgacgcctcaatcctcatcaactccacgccgggcaacctagccgagaaggactccgtggccaacaaccccagcatgcgcggcttcgacgtcatcgacgacgccaaggccgtcctcgaggcgcactgcccgcgcaccgtctcctgcgccgacatcgtcgcgttcgcggcccgcgacagcgcctgctccgccggcggcctcgagtacgaggtcccctcggggcgccgcgacggccgagtttccagacaagacgaggtgctcgacaacaatgtccccacaccaaccgacgacgtcgccgagctcatcgagagcttcaagcgcaaggggctgtccgccgacgacatggtcacgctctccggcgcgcacaccgtcggccgctcccactgctcctccttcacgcagcggctctacaacttcagcgggcagctgggacggacggacccgtccgtcgaccccgcctacgccgggcacctcaaggcgcggtgcccatggccgtccagcgacgaccagatggaccccacggtggtgccgcaggacccagtcacgccggcgaccttcgacaaccagtacttcaagaatgtgcttgcgcacaaggtcctgttcgtctccgacaacacgctgctcgacaacccctggacggccgggatcgtccaatttaacgccgcagtcgagaaggcgtggcaggtcaggttcgtcaaggccatggtcaagatgggcaaggtgcaggtgctcaccggcgatgagggagagatcagggaaaagtgcttcgtcgtcaacccacactactagctattgcaactacatacttcgagagactacctatagagctaaaaatagagattttgaagagagagaaaaaaaactactctcgcgagtgcaaataagactcttgtagacgctcgtattactctccgtggaaatctctagccagaaatcattaatataataaaggacaagtggcacgtctatcaccacaaaaaaaaaaaaaaaaa

SEQ ID NO: 96656 - protein, 339 aa, Zea mays
  misc_feature: Ceres CLONE 1712025
  misc_feature (47)..(300): Pfam Name: peroxidase Pfam Description: Peroxidase
  misc_feature: SWISSPROT Homolog: EC 1.11.1.7 Peroxidase
MSSTWLAFAWAASALVVAASTAHAPHHPSSLQVGFYKHSCPQAEDIVRNAVRRGLARDPGIGAGLIRMHFHDCFVRGCDASILINSTPGNLAEKDSVANNPSMRGFDVIDDAKAVLEAHCPRTVSCADIVAFAARDSACSAGGLEYEVPSGRRDGRVSRQDEVLDNNVPTPTDDVAELIESFKRKGLSADDMVTLSGAHTVGRSHCSSFTQRLYNFSGQLGRTDPSVDPAYAGHLKARCPWPSSDDQMDPTVVPQDPVTPATFDNQYFKNVLAHKVLFVSDNTLLDNPWTAGIVQFNAAVEKAWQVRFVKAMVKMGKVQVLTGDEGEIREKCFVVNPHY

SEQ ID NO: 96657 - DNA, 644 bp, Zea mays; identical to SEQ ID NO: 59788
  misc_feature: Ceres CLONE 15175342
  misc_feature: SWISSPROT Homolog: EC 3.2.1.23 Beta-galactosidase

SEQ ID NO: 96658 - DNA, 665 bp, Zea mays; identical to SEQ ID NO: 59803
  misc_feature: Ceres CLONE 15176022
  misc_feature: SWISSPROT Homolog: EC 3.2.1.23 Beta-galactosidase

SEQ ID NO: 96659 - DNA, 666 bp, Zea mays; identical to SEQ ID NO: 60386
  misc_feature: Ceres CLONE 15197432
  misc_feature: SWISSPROT Homolog: EC 3.2.1.23 Beta-galactosidase

SEQ ID NO: 96660 - DNA, 736 bp, Zea mays; identical to SEQ ID NO: 62717
  misc_feature: Ceres CLONE 15292772
  misc_feature: SWISSPROT Homolog: EC 3.2.1.23 Beta-galactosidase
  misc_feature (736)..(736): n is a, c, t, g, unknown, or other

SEQ ID NO: 96661 - DNA, 639 bp, Zea mays; identical to SEQ ID NO: 63141
  misc_feature: Ceres CLONE 15303602
  misc_feature: SWISSPROT Homolog: EC 3.2.1.23 Beta-galactosidase

SEQ ID NO: 96662 - DNA, 733 bp, Zea mays; identical to SEQ ID NO: 63680
  misc_feature: Ceres CLONE 15319902
  misc_feature: SWISSPROT Homolog: EC 3.2.1.23 Beta-galactosidase

SEQ ID NO: 96663 - DNA, 632 bp, Zea mays; identical to SEQ ID NO: 64329
  misc_feature: Ceres CLONE 15335532
  misc_feature (83)..(83): n is a, c, t, g, unknown, or other
  misc_feature (87)..(87): n is a, c, t, g, unknown, or other

SEQ ID NO: 96664 - DNA, 732 bp, Zea mays; identical to SEQ ID NO: 64570
  misc_feature: Ceres CLONE 15344462
  misc_feature: SWISSPROT Homolog: EC 3.2.1.23 Beta-galactosidase

SEQ ID NO: 96665 - DNA, 881 bp, Zea mays; identical to SEQ ID NO: 64577
  misc_feature: Ceres CLONE 15344532
  misc_feature: SWISSPROT Homolog: EC 3.2.1.23 Beta-galactosidase
  misc_feature (11)..(11): n is a, c, t, g, unknown, or other
  misc_feature (33)..(33): n is a, c, t, g, unknown, or other
  misc_feature (36)..(36): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other

SEQ ID NO: 96666 - DNA, 637 bp, Zea mays; identical to SEQ ID NO: 64996
  misc_feature: Ceres CLONE 15353612
  misc_feature: SWISSPROT Homolog: EC 3.2.1.23 Beta-galactosidase

SEQ ID NO: 96667 - DNA, 645 bp, Zea mays; identical to SEQ ID NO: 65340
  misc_feature: Ceres CLONE 15361332
  misc_feature: SWISSPROT Homolog: EC 2.7.9.1 Pyruvate, phosphate dikinase
  misc_feature (588)..(588): n is a, c, t, g, unknown, or other
  misc_feature (623)..(623): n is a, c, t, g, unknown, or other

SEQ ID NO: 96668 - DNA, 678 bp, Zea mays; identical to SEQ ID NO: 66008
  misc_feature: Ceres CLONE 15380452
  misc_feature: SWISSPROT Homolog: EC 3.2.1.23 Beta-galactosidase
  misc_feature (491)..(491): n is a, c, t, g, unknown, or other

SEQ ID NO: 96669 - DNA, 629 bp, Zea mays; identical to SEQ ID NO: 66687
  misc_feature: Ceres CLONE 15399622
  misc_feature: SWISSPROT Homolog: EC 3.2.1.23 Beta-galactosidase

SEQ ID NO: 96670 - DNA, 636 bp, Zea mays; identical to SEQ ID NO: 66773
  misc_feature: Ceres CLONE 15401772
  misc_feature: SWISSPROT Homolog: EC 3.2.1.23 Beta-galactosidase

SEQ ID NO: 96671 - DNA, 616 bp, Zea mays; identical to SEQ ID NO: 66913
  misc_feature: Ceres CLONE 15404532
  misc_feature: SWISSPROT Homolog: EC 3.2.1.23 Beta-galactosidase
  misc_feature (616)..(616): n is a, c, t, g, unknown, or other

SEQ ID NO: 96672 - DNA, 668 bp, Zea mays; identical to SEQ ID NO: 67098
  misc_feature: Ceres CLONE 15408552
  misc_feature: SWISSPROT Homolog: EC 3.2.1.23 Beta-galactosidase

SEQ ID NO: 96673 - DNA, 862 bp, Zea mays; identical to SEQ ID NO: 67157
  misc_feature: Ceres CLONE 15410182
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (862)..(862): n is a, c, t, g, unknown, or other

SEQ ID NO: 96674 - DNA, 651 bp, Zea mays; identical to SEQ ID NO: 67628
  misc_feature: Ceres CLONE 15424782
  misc_feature: SWISSPROT Homolog: EC 3.2.1.23 Beta-galactosidase

SEQ ID NO: 96675 - DNA, 663 bp, Zea mays; identical to SEQ ID NO: 67979
  misc_feature: Ceres CLONE 15433072
  misc_feature: SWISSPROT Homolog: EC 3.2.1.23 Beta-galactosidase

SEQ ID NO: 96676 - DNA, 657 bp, Zea mays; identical to SEQ ID NO: 67987
  misc_feature: Ceres CLONE 15433172

SEQ ID NO: 96677 - DNA, 753 bp, Zea mays; identical to SEQ ID NO: 68060
  misc_feature: Ceres CLONE 15435162
  misc_feature (753)..(753): n is a, c, t, g, unknown, or other

SEQ ID NO: 96678 - DNA, 675 bp, Zea mays; identical to SEQ ID NO: 68068
  misc_feature: Ceres CLONE 15435542
  misc_feature: SWISSPROT Homolog: EC 3.2.1.23 Beta-galactosidase
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other

SEQ ID NO: 96679 - DNA, 640 bp, Zea mays; identical to SEQ ID NO: 68812
  misc_feature: Ceres CLONE 15456912
  misc_feature: SWISSPROT Homolog: EC 3.2.1.23 Beta-galactosidase

SEQ ID NO: 96680 - DNA, 678 bp, Zea mays; identical to SEQ ID NO: 69888
  misc_feature: Ceres CLONE 15486852
  misc_feature: SWISSPROT Homolog: EC 3.2.1.23 Beta-galactosidase
  misc_feature (29)..(29): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other

SEQ ID NO: 96681 - DNA, 728 bp, Zea mays; identical to SEQ ID NO: 70466
  misc_feature: Ceres CLONE 15503072
  misc_feature (578)..(578): n is a, c, t, g, unknown, or other

SEQ ID NO: 96682 - DNA, 674 bp, Zea mays; identical to SEQ ID NO: 71837
  misc_feature: Ceres CLONE 15540902
  misc_feature: SWISSPROT Homolog: EC 1.11.1.6 Catalase

SEQ ID NO: 96683 - DNA, 853 bp, Zea mays; identical to SEQ ID NO: 73011
  misc_feature: Ceres CLONE 15572072
  misc_feature (766)..(766): n is a, c, t, g, unknown, or other

SEQ ID NO: 96684 - DNA, 818 bp, Zea mays; identical to SEQ ID NO: 77889
  misc_feature: Ceres CLONE 15628962
  misc_feature (502)..(502): n is a, c, t, g, unknown, or other
  misc_feature (507)..(507): n is a, c, t, g, unknown, or other
  misc_feature (692)..(692): n is a, c, t, g, unknown, or other

SEQ ID NO: 96685 - DNA, 1004 bp, Zea mays; identical to SEQ ID NO: 81567
  misc_feature: Ceres CLONE 15670692
  misc_feature (36)..(36): n is a, c, t, g, unknown, or other
  misc_feature (52)..(52): n is a, c, t, g, unknown, or other
  misc_feature (1004)..(1004): n is a, c, t, g, unknown, or other

SEQ ID NO: 96686 - DNA, 990 bp, Zea mays; identical to SEQ ID NO: 89359
  misc_feature: Ceres CLONE 15769772

SEQ ID NO: 96687 - DNA, 1031 bp, Zea mays; identical to SEQ ID NO: 90029
  misc_feature: Ceres CLONE 15778972
  misc_feature (69)..(69): n is a, c, t, g, unknown, or other

SEQ ID NO: 96688 - DNA, 874 bp, Zea mays; identical to SEQ ID NO: 90266
  misc_feature: Ceres CLONE 15781842

SEQ ID NO: 96689 - DNA, 1159 bp, Zea mays; identical to SEQ ID NO: 93804
  misc_feature: Ceres CLONE 15832812
  misc_feature: SWISSPROT Homolog: EC 1.3.3.9 Secologanin synthase
  misc_feature (63)..(63): n is a, c, t, g, unknown, or other
  misc_feature (66)..(66): n is a, c, t, g, unknown, or other
  misc_feature (1043)..(1043): n is a, c, t, g, unknown, or other

SEQ ID NO: 96690 - DNA, 825 bp, Zea mays; identical to SEQ ID NO: 96116
  misc_feature: Ceres CLONE 15865962
  misc_feature: SWISSPROT Homolog: EC 2.7.11.1 Non-specific serine/threonine protein kinase

SEQ ID NO: 96691 - DNA, 873 bp, Zea mays
  misc_feature: Ceres CLONE 100733084
  misc_feature: Encodes the peptide sequence at SEQ ID NO. 96692
gaaataaagcagctcctccgcggggcggcgaactactacccatcgccaaaaccctagccccgatccggtcgaggagcactacttcttggcatggcgggcacccctagccaggcaagcctcctgctccagaagcagctcaaggatcttgcgaagaaccccgtggatgggttctccgcagggcttgtagacgatagcaacgtcttcgagtggcaggtcaccatcatcggcccgcccgacaccctatatgatggaggctacttcaatgcaataatgaccttcccccagaactatcccaacagcccgccatcagtaagatttacttctgggatgtggcatccgaatgtttatccggatgggcgtgtttgcatttctattcttcatccacctggtgaagatcccagtggttatgagcttgcaagcgaacggtggacaccagtgcacacggttgaaagtatagttctgagcatcatttcaatgctctctagtccgaatgacgagtctccagcaaatattgaagctgccaaggattggagagagaagcgggatgagttcaagaagaaggttaggcaatgtgtccgcaggtctcaggaaatgctgtgaaggrggaacatgggggagtkgaatgagtctgcaatcggtgtgstgcaattcacaaccaattatytcatgtcagcattcttttgctttcccctgtatattttttcaaccgatgtcactcgtatagkggtgttgggtttctttagacaaactcggggcggtggcttatcctaaaaattagattttactgcggggcatgaaatgatcgattcgaagaatattttgaacatgctgccccctaatcaaaaaatttcatgtttaacttcataaggggtg

SEQ ID NO: 96692 - protein, 169 aa, Zea mays
  misc_feature: Ceres CLONE 100733084
  misc_feature (11)..(162): Pfam Name: UQ_con Pfam Description: Ubiquitin-conjugating enzyme
  misc_feature: SWISSPROT Homolog: EC 6.3.2.19 Ubiquitin--protein ligase
MAGTPSQASLLLQKQLKDLAKNPVDGFSAGLVDDSNVFEWQVTIIGPPDTLYDGGYFNAIMTFPQNYPNSPPSVRFTSGMWHPNVYPDGRVCISILHPPGEDPSGYELASERWTPVHTVESIVLSIISMLSSPNDESPANIEAAKDWREKRDEFKKKVRQCVRRSQEML

SEQ ID NO: 96693 - DNA, 1207 bp, Zea mays
  misc_feature: Ceres CLONE 100741474
  misc_feature: Encodes the peptide sequence at SEQ ID NO. 96694
gacaacccaggcctggttcggcccggccttcccgatttagtacaacgtctcctgtgtcctctcgcgcgccgcgccgcccctcaggccgagactcccctcaggccccagctctcgctctccggtctccaccgccgctccggtgctcccttccgggattcccctccggcgagcttgctcagctccgctccagatttccacgtcgtccatggcgctcgtcgtgatgtgtgggcagccgtgcagcggtaaaacagcagccgccgcttgccttgctgtggcgctgcactcctcctcgcctgaccttacagtccgaatcatcgatgagtcatccctccatctcaggcgcaacgatagctacaaagatatggttgtggagaaaaacttgagagggcttcttagatcagaagttgacaggtctgtgtcacgcgacagcataattattgtcgactcgttgaataatattaaggggtaccgctatgagttgtggtgtcttgcgcgtgcatctggtgtaagatattgtgtgcttttttgtgatacagaagtggaccattgtaaggaatggaacagcaaccgccaggagaaaggagaaccagcatatgatactaatatatttgaagatcttgtaagtagatttgagaagccagatagacgcaatcgttgggattcccctctttttgaattgttcccatctagagatgaattagtggaaacagctcctgttattgctgaagctgtgtcatatttgacaaaaaaagtggattccaaaacaagagatgtaaaagttttccagcctacaatagccactcagacggtgcgaacaacagaggctaattccctttatgagatggacaaggcaacacaggaggtggtcaatgcaattgttgaagcacagtcatgcggtcttgggcttgctgtgaataagatttccattgggcccaacttgccaactatcaagcttgagagatctgttggcctacctgagctcagaagcctgcggagaactttcatcaagctggcagggcagtacagtttgagtgggcccccccccccgacagatgctgacagcgcaaagaggatgtttgttgactacttaaaccgtgaacttggtgcatgataattttcatttgcctgcgttgcatgaacactatgtagcatgtggttaacttgggggaatagataattgaagacaacttgattgtacttgttcctg

SEQ ID NO: 96694 - protein, 301 aa, Zea mays
  misc_feature: Ceres CLONE 100741474
  misc_feature (1)..(296): Pfam Name: KTI12 Pfam Description: Chromatin associated protein KTI12
MALVVMCGQPCSGKTAAAACLAVALHSSSPDLTVRIIDESSLHLRRNDSYKDMVVEKNLRGLLRSEVDRSVSRDSIIIVDSLNNIKGYRYELWCLARASGVRYCVLFCDTEVDHCKEWNSNRQEKGEPAYDTNIFEDLVSRFEKPDRRNRWDSPLFELFPSRDELVETAPVIAEAVSYLTKKVDSKTRDVKVFQPTIATQTVRTTEANSLYEMDKATQEVVNAIVEAQSCGLGLAVNKISIGPNLPTIKLERSVGLPELRSLRRTFIKLAGQYSLSGPPPPTDADSAKRMFVDYLNRELGA

SEQ ID NO: 96695 - DNA, 1118 bp, Zea mays
  misc_feature: Ceres CLONE 100744631
  misc_feature: Encodes the peptide sequence at SEQ ID NO. 96696
gctgctcctctcgcccacgcccgagaccgagaggccgcgccggcgcacccaaataaacccgaggagtgcctacctggcctgggcgcctggttgagcggtaaacaaatccgtgggcgtcctgcggctgcgattagaatagagtagaattcatcagcgggtcgccgtcgccattggcgcggtgcgtgtgcgagcccgagccgtgcgaagcaggtgaggcgaggggacagacgggacacgggagcgaagcaaagcgaaggaaggagtttccagtgagcgcggatcgcggaggcggtttatatagccggagggcgcgcgctccggtccgctaacgtcctgcagggagggaagggcaggattaggcagggcagcgccgcgccggccggaccgcccgcccgcccgcccgtccacgagccacggactttcggccatgggggacgctggcgctgacgcctcctcctcgccgccgccgccgtccgggtccttctcctacttcgccgtcttccgcaactaccccctcgtcgccgccctgctcggcttcgccgtcgcccagtccatcaagttcttcgtcacacggtacaaggagaacagatgggatcccaagcggcttatcggctcgggtggcatgccgtcatcacattccgccacggttacagcactagcagtagcaattggattccaggatggctttagctgctccctctttgcaacagcaactatatttgcaagcgtggtaatgtatgatgcttttggtatcagactgcatgctggaaagcaagcagaggtattgaatcaaatagtttgtgaacttccttttgaacaccccttgtttgagacaagaccactgcgagaacttttaggccatacaccaactcaggtggttggtggtgcattgcttgggtgtacaatagccacagcaggacaattattcctttgaactacgaaggtgcggcagaaatgttgtagcatttgtatcgcagggacttgagaagaagtttctccagtgttttgctactttaggtattggtaagatttgcatgttggtgctgtagtgttgttgaatgttgtatgttttgatggaatgtggttatatgtcaaaaaggtgacgttcacaggattgc

SEQ ID NO: 96696 - protein, 168 aa, Zea mays
  misc_feature: Ceres CLONE 100744631
  misc_feature (22)..(167): Pfam Name: DUF212 Pfam Description: Divergent PAP2 family
MGDAGADASSSPPPPSGSFSYFAVFRNYPLVAALLGFAVAQSIKFFVTRYKENRWDPKRLIGSGGMPSSHSATVTALAVAIGFQDGFSCSLFATATIFASVVMYDAFGIRLHAGKQAEVLNQIVCELPFEHPLFETRPLRELLGHTPTQVVGGALLGCTIATAGQLFL

SEQ ID NO: 96697 - DNA, 1310 bp, Zea mays
  misc_feature: Ceres CLONE 100796895
  misc_feature: Encodes the peptide sequence at SEQ ID NO. 96698
atgctgtccgtcaccgcgcgcgcctccttgcccttcttcaccctttcctcccggacccggcgtctccgtgcccgtgcgtgccttctccggcctgcggtctcctccaccggccaccgctgcctcgcaattgggcagggaaatcagaccgcccccatcaaccgccctgaccgcgcgagggagatcaaacgcggaggccgtccatccctcccgcgtcatcgtgatgccaggcctcgccgcacccgagcaggacgccgtctcgctggtgcggcgcgtcgcccgcgccctcaaccgccgcttcaccgacatcgtcgcgctgctcttcagccacaagggcgctggatcgctcggcgccgtcgcggggttcgccatcgccgtggtgttcgcgtggaagttcctgcgcccccgcagacgtgctcccaagcggcccccacctacccctgcagcggctcccgctgcgagtgtgcctgatgcggccgaccctatcggagactcaggcaaggtagtaacacgggaaattgtggtgaagcgactgaaaggctgcagaaaggttacatgccaacttctcggtgttgtttttgaggagacaattcctgaggagcttcagaaacatgccaccgttagaccctccgtggtagagctgctactggaaatatccagatattgtgatctctacctaatggagactgtaattgacgataagagcgaggaaaatgctttcatggccctggagacctctggacttttcagaactggtggcctgatgaaagagaaggtgctcttttgcagctctgaagttggtcgaacttcatttgttcgacagttggaatcagattttcacatagacacgagccttgacatagtttttcaactatctcggttcattcgatgccaactatttatttccccggtggaaggagaacagcttgcaggcaacgtattcaattttccaagtcttgagcagttttttttttgatggcgggacgcaaagaaaggccttttgcactccaaacaaatgtgctgatttcccaattgtgacttgtgagttgtaggcttttagcgccccccggcctggacgcaacagaccccctacaactgttggagttcagttgtgatcatgcaagatgtatattaaacagacaataataagttggtaaaaaatattcatatttattttttatttttagtaaaagtacatggaaaatataaatatagaagctactcctggttgttttcaacttttcatttccccctagcttaagctgaaaaaagataattgaaacaggtatcagtatgatactttgcaaatacgt

SEQ ID NO: 96698 - protein, 250 aa, Zea mays
  misc_feature: Ceres CLONE 100796895
MPGLAAPEQDAVSLVRRVARALNRRFTDIVALLFSHKGAGSLGAVAGFAIAVVFAWKFLRPRRRAPKRPPPTPAAAPAASVPDAADPIGDSGKVVTREIVVKRLKGCRKVTCQLLGVVFEETIPEELQKHATVRPSVVELLLEISRYCDLYLMETVIDDKSEENAFMALETSGLFRTGGLMKEKVLFCSSEVGRTSFVRQLESDFHIDTSLDIVFQLSRFIRCQLFISPVEGEQLAGNVFNFPSLEQFFF

SEQ ID NO: 96699 - DNA, 1288 bp, Zea mays
  misc_feature: Ceres CLONE 100813129
  misc_feature: Encodes the peptide sequence at SEQ ID NO. 96700
cttcgtttaaacccaaaccctaattgcgacctccgttcccccaaaaccctacggccatggacggcggaggcggtggtgtagggggaggcggagttggggcaggtgtcatggtgggcggcggagtcgggccgggcggcggcgttggcggtggcggcgacgtggagctcgtcagcaagacgctgcagttcgagcacaagctgttctacttcgatctgaaggagaatccgcgggggaggtacctcaagatctccgagaagacctcggccacgcgctccaccatcatcgtccccgtcgacggcgtggcctggttcctcgacctcttcgactactacatccgcaccgacgagcgcgacgctttcagcaaggagctgcgactccagaccaaggtgttctatttcgatatcggggagaacaagaggggccgattcctcaaggtttctgaggcctctgtcaaccgaaaccggagtaccataattgttccagctggcagctctggtgaagagggctgggaagcattcaggagtgtactgctggagataaataacgaggctaccagattgtatgtcctaccaaatcatccaaatcagcaacacatggagccgccagagcgtcttcctggtctgtccgatgatgtgggtgccggatttatagcaggacatggtagccagtctgcttctgggccagaggtagatgtcgaacgcttggttgatctgcctcctcaagaagaaattagtggcatgggtatgtctaaggttatcagggcagatcagaaaaggttcttcttcgacctgggcagcaacaacaggggccattatttgaggatttctgaggtggctggagctgatcgttcgtctattatcttgccgctctcgggtttgaagcaattccatgaaatggttggtcactttgtagatataatgaaggacaggcttgaaggaatgacaggagctaacgtgcgcactgtcgagcccagccagagatgattacccttgactgtgggcctggcaagactgctgttatgcctcctgtaggtttgccatgtggtgtgtggtaatgtagatcacgccgtattaattcatctggtggggataataatgtctctttttctctttattttttgaattcagtggcgaggattgatttgtttgggactttttttctttctttcagtcggaggaataatatgcagtgtattgttcgtggggtggtataattgtggttgctgcagtgttagccctgattttatgcttcgccgttcttatttaggtaaaagatctgctatgtttct

SEQ ID NO: 96700 - protein, 308 aa, Zea mays
  misc_feature: Ceres CLONE 100813129
  misc_feature (34)..(288): Pfam Name: PurA Pfam Description: PurA ssDNA and RNA-binding protein
MDGGGGGVGGGGVGAGVMVGGGVGPGGGVGGGGDVELVSKTLQFEHKLFYFDLKENPRGRYLKISEKTSATRSTIIVPVDGVAWFLDLFDYYIRTDERDAFSKELRLQTKVFYFDIGENKRGRFLKVSEASVNRNRSTIIVPAGSSGEEGWEAFRSVLLEINNEATRLYVLPNHPNQQHMEPPERLPGLSDDVGAGFIAGHGSQSASGPEVDVERLVDLPPQEEISGMGMSKVIRADQKRFFFDLGSNNRGHYLRISEVAGADRSSIILPLSGLKQFHEMVGHFVDIMKDRLEGMTGANVRTVEPSQR

SEQ ID NO: 96701 - DNA, 1205 bp, Zea mays
  misc_feature: Ceres CLONE 100813841
  misc_feature: Encodes the peptide sequence at SEQ ID NO. 96702
ctcccgtgcacacccatccactcgccgcccaagcccttagcttcctgcccaacgctgctgcgcttcacgctccatcgcccctcatccaataactccaacaaagaccgggttgcttcgatctgcacacaacagaagaagcacgcccatccgcggctcttgcttcttttggcaccatgatgtcgtcggcgccggaggagacgctgttcaacctggaccagcagcagcctccgccggcggagcaggagcagatctgctacgtgcactgcagctactgcgacaccatcctcgcggtgggcgtgccgtgcagcagcttgttccagacagtcaccgtgcggtgcggccactgctccaacctgctctacgtcaacctccgcgccctcctgctgccggcggcggcggccaataaccagctaccacccttcggccagcctctcctctcccccacctccccgcacggtctacttgcgccgagcctgccgggtgctgaaccgccgagcgcttgcgtgagcggcgtcacgagcatcaacaacacgtgcggtggcaacaccaccacgtcgtcggccatgtcgtccatggcgccgccaccggccaaacatgcactgcaggaggcgcagcagctgcccaggaccgcagcgtcggtgaacagaacttcagagaagcggcagagagttccttccgcgtacaaccgtttcatcaaagatgaaatccagcgcatcaaggccagcaatccggacatcactcacagggaagctttcagcgcggctgccaagaattgggcccatttcccccacatccatttcggcctcatgcccgatcagggcttgaagaagaaccctatgcaaaatcaggagggagctgagtgcatgcttttcatggacggtctttacgccagcatgggcttttttccattctgacttcacgtcttcacccccactagggttctgttttttgaagcccctctgtgtatcccggttgccggaggaatctcgaaatgtctaccgcaaatctctctctctctctctctctctctctctctctctctctctctctctgtgtgtgggggtgtgtgtgtcctctcgttctccttacttaggttccagtttcttatttcgttaatttattattgttatgtaacctagagagcaaggttgttatgtgtatgatgctgctgccccttgtcttatatggacataatttcgagctgg

SEQ ID NO: 96702 - protein, 246 aa, Zea mays
  misc_feature: Ceres CLONE 100813841
  misc_feature (14)..(211): Pfam Name: YABBY Pfam Description: YABBY protein
MMSSAPEETLFNLDQQQPPPAEQEQICYVHCSYCDTILAVGVPCSSLFQTVTVRCGHCSNLLYVNLRALLLPAAAANNQLPPFGQPLLSPTSPHGLLAPSLPGAEPPSACVSGVTSINNTCGGNTTTSSAMSSMAPPPAKHALQEAQQLPRTAASVNRTSEKRQRVPSAYNRFIKDEIQRIKASNPDITHREAFSAAAKNWAHFPHIHFGLMPDQGLKKNPMQNQEGAECMLFMDGLYASMGFFPF

SEQ ID NO: 96703 - DNA, 536 bp, Zea mays
  misc_feature: Ceres CLONE 100818630
  misc_feature: Encodes the peptide sequence at SEQ ID NO. 96704
gccactgaaacgtttacagagcgcttcgttctagcagcagcggacgagggagacaagaggaggaagagatggcaggccgtgatggagccaagtcatcggcgtccatggaggaagaggcatgcggggagaagaagtacggaggaatcgcacccaagaagaagcctttgatatccaaggaccacgagcgcgcctacttcgactctgcagactgggtgctgggcaaggctgcgaacagtagcacgagggccaccgtcgagtctctgaagcccaagctgaagagaacgcctcaccaccagctgccccctcgcaagcccacctgcgcttccggttgagacgaccggacccatggctacgcgttgcagctgctcggaggtgagggagggaggacgccgaggccgagctcacataaatgtctagctggtcggaaaccgtggtagggacgaatccgagatgcaatctggcttgttggccgttgcattgcagcacctattgtgtctttatcagttcgttatcaattatctggctttaagtttggc

SEQ ID NO: 96704 - protein, 87 aa, Zea mays
  misc_feature: Ceres CLONE 100818630
  misc_feature (20)..(88): Pfam Name: Lg106 Pfam Description: Lg106-like protein
MAGRDGAKSSASMEEEACGEKKYGGIAPKKKPLISKDHERAYFDSADWVLGKAANSSTRATVESLKPKLKRTPHHQLPPRKPTCASG

SEQ ID NO: 96705 - DNA, 1300 bp, Zea mays
  misc_feature: Ceres CLONE 100821134
  misc_feature: Encodes the peptide sequence at SEQ ID NO. 96706
tgaaaactggggcaaaaggtcattgcgccgtcgtcgtcgtcgttcgcaagcagcaaccaggcagctccgggctccggccatggcatcaccaccaaggaatgtcggtaccaggactaccagcaacccggagatcccagagttcctggtgggcccggctggccggccggtgccggccgtggggctcggcacggcatcgttcccgttcgtggaggaaaacgtcaggaccgccgtcctcgcggcactggagctcggataccgccacctcgataccgcttcgctctaccgctccgaacgtgccgtcggcgacgccgtggccgaggcagcgcggcgcgggatcgtggcgtccagggaggaggtgttcgtgacgaccaagatgtggtgctcgcagtgccacccggatctcgtgctaccttccctcaaggagagcttgcagaaccttcaaatggattatgttgatttgtacctggttcattggccgatagctgcaaagcccggcaagccacagttcccgtttaaaagggaggacatcatgcccatggacctaataggtgtatggcgggcaatggaggaatgccaccggcttggccttgctaggatgattggtgtcagcaatttcacaacaaagaagctccaagagctactggccattgctaaaatccccccgtcagtaaatcaggttgaaatgaatccaatttggcagcagaaaaggttagctgagttctgcaaagacaaaggtattcatttgactgcctattctccgctagcaggccaaagcacgtctaaggtcaatccagtaatgcagtctgaggttctgcaagaggttgcaaaggctagaggaaagtcagtggctcagatttcgctgaggtggatctacgagcaaggcgctagcgtggttgtcaagagtttcggaagggataggctcaaggagaacgtggaaatcttcgattgggaactgaccaatgaagacaggcgtaagattagtcagatacctcagcacaagagggtcacagtgttggggatcctcagcccagacggcgtctccagcgtggatcttgctgagcttgatattgttgaaatgtagcagaaatctccatctatcaggttgcaaggacaaaaaatggtgattggagtagctttcatacggctacgttgaatcagttgcttagatacggccatattgaatcaagaattagaagtagaggacgatctctctacttgtcgtccggacctcattttcttaaaatgtattttcaggtgtctgaccttgtcctgaaatgccatccaggccattactttttag

SEQ ID NO: 96706 - protein, 333 aa, Zea mays
  misc_feature: Ceres CLONE 100821134
  misc_feature (24)..(305): Pfam Name: Aldo_ket_red Pfam Description: Aldo/keto reductase family
  misc_feature: SWISSPROT Homolog: EC 2.3.1.170 6'-deoxychalcone synthase
MASPPRNVGTRTTSNPEIPEFLVGPAGRPVPAVGLGTASFPFVEENVRTAVLAALELGYRHLDTASLYRSERAVGDAVAEAARRGIVASREEVFVTTKMWCSQCHPDLVLPSLKESLQNLQMDYVDLYLVHWPIAAKPGKPQFPFKREDIMPMDLIGVWRAMEECHRLGLARMIGVSNFTTKKLQELLAIAKIPPSVNQVEMNPIWQQKRLAEFCKDKGIHLTAYSPLAGQSTSKVNPVMQSEVLQEVAKARGKSVAQISLRWIYEQGASVVVKSFGRDRLKENVEIFDWELTNEDRRKISQIPQHKRVTVLGILSPDGVSSVDLAELDIVEM

SEQ ID NO: 96707 - DNA, 1317 bp, Zea mays
  misc_feature: Ceres CLONE 100823873
  misc_feature: Encodes the peptide sequence at SEQ ID NO. 96708
ccgcgctgcttgcctcgccttgctctcggttcgtggggcatggcggcttcgccggcttgtgctccggggctcatctccggccccaccctccctcccctgcccgttgccttccgctgctactgggcccaaaagccctcctccgcgtcgacctcctccaggcgcccgtgccgcaggcggttcgttcccgttgcagctgcctccacccgcacctcctctgcggctgctcggggcctcgacgccgacgacttccgccacccgctggacaagcagaacactctgctgctgagagcaattcccgggctcaacgacgtgggcaaagctttgctaggacccgtctcggagcaagttatggtactccagaacattggaacatcagttctcgtctccccgaaccagcttccagatctccaccaactgctggttgaggctgcgaagctcttgaacaccgaagctcctgacttgtacataaggcagaatcctgttccaaatgcctacaccttagcaatcaacggcaaaaaaccattcattgtcgttcacacaagccttgtggagctgcttactccaagggaattgcaggctgttttggctcatgagctgggtcacctcaagtgcgatcatggtgtttggctcacttttgccaatatactcacaatgggagcatacactgtccctggttttggcatggttgctggcttcctggaagagcagctatacagatggctacgagctgcagagctgacttgtgacagggcagctcttcttgtggtgcaagatccgaaggtagtcatttttgttttgatgaaattggccggaggatgcccatctcttgccgccaagctaaatgtggatgccttcctggagcaagctcgtttgttcgacaaggctgcatcgaacccagttgggtggtacatccggaatgcacaaaccagagagctttcaccccctttgcctgtgatgcgagccagagagatcgatgagtggtcaagaagccaggagtacaagaccgtaatgcaaaaaatgtttcagatggggctgaacagagtatagttagtggcgacacatacgaagaggtctgtacatggaatccatcatgtttttttgcaaggatttagctttagatcatgactgtcctttcctgtatatctgatcatgagtttgtgattttttcctgggtggctgggccccgttttttttccaggactgtagagtctgtagcttgtgtatggaagggaatgtctgtatatggagaaggctggtgtttttggaaaaaaaacagatacaaacatagacatattgtatatatttgcagttgaattt

SEQ ID NO: 96708 - protein, 335 aa, Zea mays
  misc_feature: Ceres CLONE 100823873
  misc_feature (130)..(321): Pfam Name: Peptidase_M48 Pfam Description: Peptidase family M48
MAASPACAPGLISGPTLPPLPVAFRCYWAQKPSSASTSSRRPCRRRFVPVAAASTRTSSAAARGLDADDFRHPLDKQNTLLLRAIPGLNDVGKALLGPVSEQVMVLQNIGTSVLVSPNQLPDLHQLLVEAAKLLNTEAPDLYIRQNPVPNAYTLAINGKKPFIVVHTSLVELLTPRELQAVLAHELGHLKCDHGVWLTFANILTMGAYTVPGFGMVAGFLEEQLYRWLRAAELTCDRAALLVVQDPKVVIFVLMKLAGGCPSLAAKLNVDAFLEQARLFDKAASNPVGWYIRNAQTRELSPPLPVMRAREIDEWSRSQEYKTVMQKMFQMGLNRV

SEQ ID NO: 96709 - DNA, 1210 bp, Zea mays
  misc_feature: Ceres CLONE 100824157
  misc_feature: Encodes the peptide sequence at SEQ ID NO. 96710
cagatcctgaagctggtgctctccctgcagatccccaatcaccagacgatgggcttatgagagtgagccagcaccccagcacagcaactgtgttaccggcatcactaccactgcgagagagctcaagaagccagcaggctccaactcccacagtacttgtgagaaccaaagctcagctgctcatccatggacatgtcgccgaaccccgacagcccctcgtcaggagggggcaacggcatcgggccgagcagcggaggcgcatcgccgtcggttggttccatgacgccgcagtcgccgagccggtacgaggcgcagaagcggcgcgactggaacacgttcgggcagtacctgcggaaccaccggccgccgctgagcctggcgcagtgcagcggggctcacgtcctggagttcctccgctacctggaccagttcggcaagaccaaggtgcacggcccggcgtgccccttcttcggccatccgaacccgccggcgccgtgcccctgcccgctccgccaggcctggggcagcctggacgccctggtgggccgcctccgcgccgccttcgaggagaacgggggccgcccggagtccaaccccttcgcggcgcgcgccgtgcgcctctacctccgcgaggtccgcgagcaccaggcccgcgcccgcggcgtcagctacgagaagaagaagcgcaagaagccgcagcagctgcagggcgacagcagcggcggccttcacggccacgcgcaccagccgccgccgccgcccccgccgcccgccggcgccgcctgctgagcctgagatgttccatcgtcgcctcgacggctcgtagcctcgtacgtacgtacgtacgctctcccatttggccggtatgatgccagattgagcttgagcatacatattttatgtatcatctcgcgcgcgtatgcgtgcatgcatgtgcatggcagcagtagtgtatgatgatccgtgtactctacccgtgagaagcactactatctagtacgtgtgtgtactgcattgctggtcctgtgttttcgattcgctttggtgttgtcggatctatttgcattgcttgtaggagtgagcaagtgtgtttgctgtactttggactgaggagtagtatgtccgtcgtccgtacgtcctttgaggtctagctagggacagggagatacatatatggtgatctctctttgctgcagcttctgtttgtggg

SEQ ID NO: 96710 - protein, 200 aa, Zea mays
  misc_feature: Ceres CLONE 100824157
  misc_feature (21)..(153): Pfam Name: DUF640 Pfam Description: Protein of unknown function (DUF640)
MDMSPNPDSPSSGGGNGIGPSSGGASPSVGSMTPQSPSRYEAQKRRDWNTFGQYLRNHRPPLSLAQCSGAHVLEFLRYLDQFGKTKVHGPACPFFGHPNPPAPCPCPLRQAWGSLDALVGRLRAAFEENGGRPESNPFAARAVRLYLREVREHQARARGVSYEKKKRKKPQQLQGDSSGGLHGHAHQPPPPPPPPAGAAC

SEQ ID NO: 96711 - DNA, 1236 bp, Zea mays
  misc_feature: Ceres CLONE 100827336
  misc_feature: Encodes the peptide sequence at SEQ ID NO. 96712
cgagaacaggtcgttttcactctgcgtctccgcatcaaaacccttagctgcctcgcaattttttttcccgttcaccggagaaagaatggcgctgccgacagctaacccgggcttccgtctcggctgccaggagtctcccgcgatgggattgaggtcggcgccgcggttggcactgcgtcgtcccggcgcggtctccgggcacaggacattaactggtgatatcacaagtctcagactaatcactgcagtgaaaacaccttatttgccagatggaagattcgatcttgaagcatatgattctttgataaacatgcagatagagggtggttctgaaggcgtaattgttggtggaacaacaggagagggtcacctaatgagctgggatgaacacattatgcttattgggcataccgttaactgctttggcactagaattaaagtgataggcaacacaggaagtaattctaccagagaggctgttcacgcaacagagcagggatttgctgttggcatgcatgcagctctccacatcaacccctactatgggaaggtatcaactgaaggattgatctctcattttgaggctgttctgccgatgggtccaaccatcatttacaatgtgccatccaggagtggccaggatattcctcctcaagttatcgagacactctcaggttatccaaacatggcaggagtgaaagaatgtgtcggacatgagagggtcaagtgctacaccgacaaaggtataacagtatggagcggtaatgatgatgagtgccatgattctaggtggaaatatggcgccactggagttatttctgtagcaagcaaccttgttcctggcctcatgcgtagtctcatgtatgaaggggagaatgcgttgctaaatgagaagctgttgcctctgacgaaatggttgttctgtctgccgaatcccatcgcactcaacactgctctggctcagcttggggtggcaaggcctgttttcaggttgccgtatgttcctcttcctcttgagaagaggattgagtttgtccggatagttgaagctattggacggggaaactttgtaggacagcaagaggcacgtgttctcgacgatgatgattttgttttgatcagtaggtattagtaagcgagcttgtttactttggtgaataaaatataatagcatcatgttatgaggatttttcagtcttttgtaaagaaataaaacagctaatcctgattttgctt

SEQ ID NO: 96712 - protein, 348 aa, Zea mays
  misc_feature: Ceres CLONE 100827336
  misc_feature (47)..(324): Pfam Name: DHDPS Pfam Description: Dihydrodipicolinate synthetase family
  misc_feature: SWISSPROT Homolog: EC 4.2.1.52 Dihydrodipicolinate synthase
MALPTANPGFRLGCQESPAMGLRSAPRLALRRPGAVSGHRTLTGDITSLRLITAVKTPYLPDGRFDLEAYDSLINMQIEGGSEGVIVGGTTGEGHLMSWDEHIMLIGHTVNCFGTRIKVIGNTGSNSTREAVHATEQGFAVGMHAALHINPYYGKVSTEGLISHFEAVLPMGPTIIYNVPSRSGQDIPPQVIETLSGYPNMAGVKECVGHERVKCYTDKGITVWSGNDDECHDSRWKYGATGVISVASNLVPGLMRSLMYEGENALLNEKLLPLTKWLFCLPNPIALNTALAQLGVARPVFRLPYVPLPLEKRIEFVRIVEAIGRGNFVGQQEARVLDDDDFVLISRY

SEQ ID NO: 96713 - DNA, 983 bp, Zea mays
  misc_feature: Ceres CLONE 100827798
  misc_feature: Encodes the peptide sequence at SEQ ID NO. 96714
gctagcatcgatccgccattgctcaccgcacaagtgcacgctcacctcacacacgcagctaagtagctaacgccgtaggcgagaacaagaaaaggctcgacatggccgaggagaagaagcagggcctgcagctgctggacttctgggtgagcccattcgggcagcgctgccgcatcgcgctggacgagaagggcctggcctacgagtacctggagcaggacctgaggaacaagagcgagctgctcctccgcgccaacccggtgcacaagaagatccccgtgctgctgcacgacggccgccccgtctgcgagtccctcgtcatcgtgcagtacctcgacgaggcgttcccggaggcggcgccggcgctgctccccgccgacccctacgcgcgcgcgcaggcccgcttctgggcggactacgtcgacaagaagctgtacgactgcggcacccggctgtggaagctcaagggggacggccaggcgcaggcgcgcgccgagatggtcgagatcctccgcacgctggagggcgcgctcggcgacgggcccttcttcggtggcgacgccctcggcttcgtcgacgtcgcgctcgtgcccttcacgtcctggttcctcgcctacgaccgcttcggcggcgtcagcgtgggagaaggagtgcccgaggctggccgcctgggccaagcgctgcgccgagcgccccagcgtcgccaagaacctctacccgcccgagaaggtctacgacttcgtctgcgggatgaagaagaggctgggcatcgagtagagcatccatcggtcggccggtggctggccgggagtaataatgacgaaccaataatctagttttggttttagtgtgctcagcagagcagttcgtgttcatgagttcgtcgtcgttgtattttctattgtcagcggtggcagcgccgtacgtgttgcctcgtacaccacaaccgaataaatggttatgaatttcttcttgttgtcttc

SEQ ID NO: 96714 - protein, 244 aa, Zea mays
  misc_feature: Ceres CLONE 100827798
  misc_feature (7)..(80): Pfam Name: GST_N Pfam Description: Glutathione S-transferase, N-terminal domain
  misc_feature (102)..(198): Pfam Name: GST_C Pfam Description: Glutathione S-transferase, C-terminal domain
  misc_feature: SWISSPROT Homolog: EC 4.4.1.5 Lactoylglutathione lyase
MAEEKKQGLQLLDFWVSPFGQRCRIALDEKGLAYEYLEQDLRNKSELLLRANPVHKKIPVLLHDGRPVCESLVIVQYLDEAFPEAAPALLPADPYARAQARFWADYVDKKLYDCGTRLWKLKGDGQAQARAEMVEILRTLEGALGDGPFFGGDALGFVDVALVPFTSWFLAYDRFGGVSVGEGVPEAGRLGQALRRAPQRRQEPLPAREGLRLRLRDEEEAGHRVEHPSVGRWLAGSNNDEPII

SEQ ID NO: 96715 - DNA, 799 bp, Zea mays
  misc_feature: Ceres CLONE 100829001
  misc_feature: Encodes the peptide sequence at SEQ ID NO. 96716
gttacacgcagcagatcagagaggcacacgcactaggtacctgcagtctggtctgcaggtacgctagcgatctagctaccgctgtgctgcgtacagtacgtagtaccatggcgaagaaagtggccactctgctggccctcaacctcctcttcttcgccttcgccgacgcatgcggctgcaggtgcggcggatcctgccctagtccaggcggcggtggcggtggaggatctggtggtggtggtggtggaagcggtgggggtgggagtggagggggtggatcgggtggtgggagcggtgggggtgggagtggaggcggaggatctggtgggggcggcagcagtggtggaggcggcggcagcggtggtggaggcggaggaggatctggtggtggcggcggcggcggcggtgggacgagcggtcgttgccccgtggacgcgctgaagctgggcgtgtgcgccaacttgctgaacgggctgatcaacgcgaccctggggacgccgcccaggacgccgtgctgcacgctgatccaggggctggcggacctggaggcggcggtgtgcctctgcaccgtcctcagggccaacgtcctgggcatcaacctcaacctgcccatcaacctcagcctcctcgtcaactactgcggcaggcgcgtcccatcgggcttccagtgcttctgatatatatggtgtagtattatatatgtccatgcatgcaatgcatctcgtcgtccatcacatgttgttgttgttgtgtgtgttttcgatgatcctgtctctgttataaatatcattattattac

SEQ ID NO: 96716 - protein, 189 aa, Zea mays
  misc_feature: Ceres CLONE 100829001
  misc_feature (106)..(188): Pfam Name: Tryp_alpha_amyl Pfam Description: Protease inhibitor/seed storage/LTP family
  misc_feature (1)..(106): Pfam Name: GRP Pfam Description: Glycine rich protein family
MAKKVATLLALNLLFFAFADACGCRCGGSCPSPGGGGGGGSGGGGGGSGGGGSGGGGSGGGSGGGGSGGGGSGGGGSSGGGGGSGGGGGGGSGGGGGGGGGTSGRCPVDALKLGVCANLLNGLINATLGTPPRTPCCTLIQGLADLEAAVCLCTVLRANVLGINLNLPINLSLLVNYCGRRVPSGFQCF

SEQ ID NO: 96717 - DNA, 1271 bp, Zea mays
  misc_feature: Ceres CLONE 100832796
  misc_feature: Encodes the peptide sequence at SEQ ID NO. 96718
cgcctctcctctccgtttgctttgcattcaccccttgccgcacacatcaggaaggcgggcaggcgacgacaatgacgatgatggcgccgcatccgcagccactgccgctgccacagccgccggcgccgttcggggacaccacgctcaccaaggtgttcgtgggcgggctggcgtgggagacccacaaggacgccctccgcgagcacttcgagcgctacggcgacatcctcgaggccgtcatcatctccgacaagctcaccggccgctccaagggctacggcttcgtgacgttcaaggaggcggacgcggccaagaaggcgtgcgaggacgccacccccgtcatcaacggccgccgcgccaactgcaacctcgccgccctcggcgccaagccgcgccccccgccacacatcctccgcccttcgccgccggccaccccggcgccgcacgcgcccgcgctcccctcgcaacaccagcccacgccagccatcgccgtggggtccaggggcgtgtcgccggtgccgtggtactaccacccctccacgacgccgccgccaccggccgcgcaccactacgcccacggcgcgcaccagcagtaccacggcgtgctcccgttctaccccgccgccgccgccacctacgggtacgccccgaattacgtcgcggacctgagctacaatgcgaaggtaggccaggcggcagctggcggcacgggcgggtcctacctgcaggggcacttcgcgtacccggcggcggcggcagcgcagggcggcatggtggcggcggcgcccaacggcatggtgccggtgtacccgttctaccactaccaccagtaccacgcctcgcaggggggagtcgccgccgcgcacttcttccccccggtctccgccgccgccgtccccgccgtcgtctccaagcacaccgtcatggccgctcccaaagtggagcaggtgacaggctgcagctgaaggcacgaggcgatcgatgatggcgacgacgagcggcggaacgaaaggagcaggccaaacaggctgagctgcacatgaagggtgtcgtccgtctgtcgggagggcccgaagcgacgcaaggcccgggcccccattaggccattgctacatcccccctctgacttcgtgcgtggctgcacggccaccgtgccgggcaagaacagtctgtaacaaatgattcgattcgtctctctctcgtttaccaaccgtatttttttccaatggtaaacccgttaccagtgtctgtagggggcagcggaccccaat

SEQ ID NO: 96718 - protein, 297 aa, Zea mays
  misc_feature: Ceres CLONE 100832796
  misc_feature (28)..(98): Pfam Name: RRM_1 Pfam Description: RNA recognition motif. (a.k.a. RRM, RBD, or RNP domain)
MTMMAPHPQPLPLPQPPAPFGDTTLTKVFVGGLAWETHKDALREHFERYGDILEAVIISDKLTGRSKGYGFVTFKEADAAKKACEDATPVINGRRANCNLAALGAKPRPPPHILRPSPPATPAPHAPALPSQHQPTPAIAVGSRGVSPVPWYYHPSTTPPPPAAHHYAHGAHQQYHGVLPFYPAAAATYGYAPNYVADLSYNAKVGQAAAGGTGGSYLQGHFAYPAAAAAQGGMVAAAPNGMVPVYPFYHYHQYHASQGGVAAAHFFPPVSAAAVPAVVSKHTVMAAPKVEQVTGCS

SEQ ID NO: 96719 - DNA, 1255 bp, Zea mays
  misc_feature: Ceres CLONE 100832970
  misc_feature: Encodes the peptide sequence at SEQ ID NO. 96720
gcaagcacacacacaccttccaccgggcctggctttaaagctgtacttactatttatttctccctccccccacaaacctcatctcttctctcccgccgcgcgccactggaaaaaaaaaaggaaaagaagagagaaaaaaaccctccatgtgttccatatttccttcgcattcagtcatcggcgtatcgtcgcaggcgcaggctgctgctgctggcggcggcggcgggtttcagagcccagagagcagagccagcagcatgagcggcggcggctctctgccctccccttccggacctgcctgctccagatcatggtccatcagcgaggactcgctgcggaggtacgtgagctacgcgagcgagagctgcatccaggagctgctggcggcgtcgtcggactccggccgcggcggcgacgacgacgggtggaaggtgctggtgtaccacaacggcgtcgagatatccaagcggcggacggggcccgcgcacgtcttccggagcaggtggctgctgcaggacgtctcgccggagcagttcgtggccgccgccagcgccgtcgacgccgccaagcagtgggagtcggaccagctggtggagtcttcgtacatcagggagctcggcgacgacctgagcatcatccacctcaagttcggcgacgcctcctcctccaccaggaggcccgcccggcgccgtgacctggtcgtctatgagcggcgccaggccatggacgacggcacgctggtggtcgcggtggcctcgctgcccaaggagatcgccgcggggctgctaccgccgcccgcggccaccggcaagggcggcggaggctccgtcgtcggccgcagcctgctgctgcagtccggctgggtcgtcgaaaggctcgacggcgacgccggctcctgcgtcgtcacctacgtcgtgcagctggacccggccgccgggtggctgccgcggtgcatcgtcagccggctcaacagcaagctcgtcatgatcatcgccaagctcaggaggatcgcgcaggccaccgtgcctgccgccgccgcagaggtgtgacgtgcatagctaccagcaagtgatcgaaatcgaactagcagcatcgggtcagctgcacgtttagttgcattgtgtgtgtgcctaagtaaatagatatatacgtactatatgtcttctttttgtagggacagagggcatgcgtctatcttgggatgcacccgcatctgtatacgtactgctacaagactatgtcagtgagaattact

SEQ ID NO: 96720 - protein, 300 aa, Zea mays
  misc_feature: Ceres CLONE 100832970
MCSIFPSHSVIGVSSQAQAAAAGGGGGFQSPESRASSMSGGGSLPSPSGPACSRSWSISEDSLRRYVSYASESCIQELLAASSDSGRGGDDDGWKVLVYHNGVEISKRRTGPAHVFRSRWLLQDVSPEQFVAAASAVDAAKQWESDQLVESSYIRELGDDLSIIHLKFGDASSSTRRPARRRDLVVYERRQAMDDGTLVVAVASLPKEIAAGLLPPPAATGKGGGGSVVGRSLLLQSGWVVERLDGDAGSCVVTYVVQLDPAAGWLPRCIVSRLNSKLVMIIAKLRRIAQATVPAAAAEV

SEQ ID NO: 96721 - DNA, 1321 bp, Zea mays
  misc_feature: Ceres CLONE 100833662
  misc_feature: Encodes the peptide sequence at SEQ ID NO. 96722
caaacctttggaggcacgggcacgggcacggggcaccgaagtgttggtatacgcggcagccgggatagcgagcgtatggccacctacttcgtcctcaacaccggcgcgaagatcccgtcggtcgggctcggcacctggcaggccgacaacgggctcgtcggcgacgccgtctatgccgccgtgaaggcaggttacaggcacattgactgtgctcaagcatacaacaacgagaaagaggtcgggtttggtctcaggagagtgctggacgagggcatagtcaagcgtgaagatctcttcatcacctccaagctttgggacattaaccatgcggcggaggacgtcccggttgcactgaacggcacactgaaggacttgcaaactgactacgtggatctctacctcatgcattggccggtgaggatgaagaaaggcgccggcttcggcccgcacgccgtcgtcccgtcagacatccccgcgacgtgggccgcgatggaggagctgtacgacgccgggaaggcgcgcgccatcggcgtcagcaacttctcgagcaagaagctggcggacctgctggccgtggcgcgcgtgcgccccgccgtcgaccaggtggagtgccacccggtgtggcggcagggcaggctccgcgcgttctgcgcctcccaagggatacacctctccgcctactcgccgctgggctcgccgggcacggcgacggtgaaggcgggcgcggtgctggagcacccggccgtcgtctcggcggcggagacgctggggaagacgccggcgcaggtggcgctgcgctggggcgtccagatggggcacagcgtgctcccgaagagcaccgacgaggggaggatcagggcgaatctcgacgtcttcggctggtccttgccggaggacctgctcgccaagttctctgagatcgagcaggaacggctgattcgtgcgggcttctttgttgatcccgacggcgtgttcaaatccatcgaggagttttgggatggcgagatctgaacaactgtcctgactgggaggagctgagtgacggaatttggccactggcaaggcgtactgtgcctgtggaagaataaatttatgcgtatgaactctgaaaggcagcgtagttttcaggtagtttgtgctcggcactccaataattcctcgatgctcaagtggtctatctatcctctaaactctaaaggccatgccgctcaagcggtcttttaagccagcatatgcacaatgggaaaataggtgctaagactctctccagcaagatccggtaaaaggtccggtactctaaatttatcgtttctttggctcc

SEQ ID NO: 96722 - protein, 311 aa, Zea mays
  misc_feature: Ceres CLONE 100833662
  misc_feature (7)..(284): Pfam Name: Aldo_ket_red Pfam Description: Aldo/keto reductase family
  misc_feature: SWISSPROT Homolog: EC 1.1.1.21 Aldehyde reductase
MATYFVLNTGAKIPSVGLGTWQADNGLVGDAVYAAVKAGYRHIDCAQAYNNEKEVGFGLRRVLDEGIVKREDLFITSKLWDINHAAEDVPVALNGTLKDLQTDYVDLYLMHWPVRMKKGAGFGPHAVVPSDIPATWAAMEELYDAGKARAIGVSNFSSKKLADLLAVARVRPAVDQVECHPVWRQGRLRAFCASQGIHLSAYSPLGSPGTATVKAGAVLEHPAVVSAAETLGKTPAQVALRWGVQMGHSVLPKSTDEGRIRANLDVFGWSLPEDLLAKFSEIEQERLIRAGFFVDPDGVFKSIEEFWDGEI

SEQ ID NO: 96723 - DNA, 1345 bp, Zea mays
  misc_feature: Ceres CLONE 100837097
  misc_feature: Encodes the peptide sequence at SEQ ID NO. 96724
cccaaacaaccacactgacatctcatcttgatccatccagctttgcctcgatcgccggccggtagccatgtcccccacggaagaagccgctggtggtggtggcgacgactatgaccgcttgagcgagctgaaggcgttcgacgacagcaaggccggcgtcaagggcctcgtggacgctggcgtcacgaccatccctgccatcttccgcggccatctccttcaggaagggccgaaggtatcgtcctctagcagtagcagcagtactagtcttagcattatcccggtcatcgacctctcggcggcggacgcagtcgcacgggaggaggtggtcgcccagttgaaggctgcagccgagacggtggggttcttccagctggtgaaccacggcgttcccagcgagctcctgtgcgagatgctgccgtcggtgaggcggttcaacgaggagccccacgaggtgaagcggccctactacacgcgggacgcacgtcgcaaggtgcggttcaactccaacttcgatctgttccagtcgccggcggccaactggcgcgacacgctcttctgcgaggcagcgccggagccgccgcgggcggaggagctgccggtcgccgtcaggcacgtgatgctggagtacggcggcgcggtgcgggaggtggcggcgcgcgtgctggggctgctctcggaggccctggggctgagccccgggcacctcgcagggatggggtgcgcggagggcctcagcctggtgtgcaactactacccgccgtgcccggaaccggacctcaccctgggctgcagcaggcactcggaccccagcttcctgaccgtgctgctgcaggactcgcatgcgcagggcggcctgcaggcgctcctcgcatccaggtggctggacgtgcctccggtggccggcgcgctcctggtgaacgtcggagaccttctccagctggtcagcaacgggcggttcaagagcgtggagcaccgggtggtggctaaccggagcagggacacggcgagagtgtcagtggcgtgcttttgcaacgcggacatcgcgagatccacgaggctgtatggacccatcgcggagctcatcgccgcggacgacagcgacggcgcgggaagggcgctgtacaggaacgtgacggtcccggagttcctagcgcactacgacaagaaaggcctcgacggtcgcccggcgctccaccgcttccagctgcttcaataattttacatcacatcagtcctgactctggtgatatcatgtcagtatgtcactgtgggctactccggtactttaatacagttatggatggatcagatcaatactaatctctggtaattttttttaagg

SEQ ID NO: 96724 - protein, 383 aa, Zea mays
  misc_feature: Ceres CLONE 100837097
  misc_feature (221)..(324): Pfam Name: 2OG-FeII_Oxy Pfam Description: 2OG-Fe(II) oxygenase superfamily
  misc_feature: SWISSPROT Homolog: EC 1.14.11.20 Desacetoxyvindoline 4-hydroxylase
MSPTEEAAGGGGDDYDRLSELKAFDDSKAGVKGLVDAGVTTIPAIFRGHLLQEGPKVSSSSSSSSTSLSIIPVIDLSAADAVAREEVVAQLKAAAETVGFFQLVNHGVPSELLCEMLPSVRRFNEEPHEVKRPYYTRDARRKVRFNSNFDLFQSPAANWRDTLFCEAAPEPPRAEELPVAVRHVMLEYGGAVREVAARVLGLLSEALGLSPGHLAGMGCAEGLSLVCNYYPPCPEPDLTLGCSRHSDPSFLTVLLQDSHAQGGLQALLASRWLDVPPVAGALLVNVGDLLQLVSNGRFKSVEHRVVANRSRDTARVSVACFCNADIARSTRLYGPIAELIAADDSDGAGRALYRNVTVPEFLAHYDKKGLDGRPALHRFQLLQ

SEQ ID NO: 96725 - DNA, 1352 bp, Zea mays
  misc_feature: Ceres CLONE 100843622
  misc_feature: Encodes the peptide sequence at SEQ ID NO. 96726
cacgccagaaactaatccagatagctagcctttgatttctcacttcaatctgacgaagtgcacacctaggcaacaaactcgaacgcgcgcggtagtggagccgagatgcagggaggggcgacggccaagcagcaggcgcgagacggtgaccgcggcgcggcgaagacgccgacgacggaggggaagggcgacgccgccggcgccaaggctagcgccgacgtggcgaagggcgacgccgccgtcgccaaggctgctggggacgacgtcgtcgtagggaagggcgacgcaggcaacaaggccggcgccggggccatgcaccacggcctgtcggccgtggaggcgaaggactcccagaccatcgtcgcgctgcagtcgccggtgaccgtcatgcgccccgtccgcggcgacctcgaggagcacctccccaagccatatctggcgcgagccctggtggcgccggacatctaccaccccgacggcaccgcggccgacgagcacggccaccaccacatgagcgtgttgcagcagcacgtcgccttcttcgaccgcgacgacaacggcatcatctacccttgggagacgtactccggatgccgtgcgcttgggttcaacatgatcctgtctctcttgatcgctcttgtcgtgaacgggaccatgagctatgccacgctgcctgggtggctgccgtcccctctgttcccgatctacgtccacaacatccacaagagcaagcatggcagtgactctgggacctacgacaacgagggcaggttcatgccagtgaacttcgagaacctgttcagcaagtacgcgcgcacttccccggacaggctcacctacagggagctctggtcgatgacggaggggttccgcgacgccttcgacctctacggctggattgcggcgaagctggagtggacgatcctgtacgtgctggcgcgggacgacgaggggtacctgtcgcgggaggccatgcggcgcgtgtacgacggcagcctcttcgagtacgtggagaggcagcgcgcgcagcacgccaagatgtcctagctagagggaagaggatgcgacgtgggcacgtggcctcgatcgcgcgtgaatgaaatggaagccaagtgaacctgtctcggctggtatgtagatagtgagaagggtgtcggccggaaaacaagcagccgtgtgtactactccctcagctcccatcaataacgcagagttcgccggaccggcacctccccatctttgctacttcaacctggtttttcgcgcggtttatgtggctgtctgaagcgagacatgaatttgcgtattgtttaattttacaaaactactgaaatgaacaaaattggcctatt

SEQ ID NO: 96726 - protein, 313 aa, Zea mays
  misc_feature: Ceres CLONE 100843622
  misc_feature (131)..(304): Pfam Name: Caleosin Pfam Description: Caleosin related protein
MQGGATAKQQARDGDRGAAKTPTTEGKGDAAGAKASADVAKGDAAVAKAAGDDVVVGKGDAGNKAGAGAMHHGLSAVEAKDSQTIVALQSPVTVMRPVRGDLEEHLPKPYLARALVAPDIYHPDGTAADEHGHHHMSVLQQHVAFFDRDDNGIIYPWETYSGCRALGFNMILSLLIALVVNGTMSYATLPGWLPSPLFPIYVHNIHKSKHGSDSGTYDNEGRFMPVNFENLFSKYARTSPDRLTYRELWSMTEGFRDAFDLYGWIAAKLEWTILYVLARDDEGYLSREAMRRVYDGSLFEYVERQRAQHAKMS

SEQ ID NO: 96727 - DNA, 1192 bp, Zea mays
  misc_feature: Ceres CLONE 100845730
  misc_feature: Encodes the peptide sequence at SEQ ID NO. 96728
cacctcagctctcagagaggaaggacactgcggccgggcgatggcgagcgtggagggcaagagggagacggtgctggtcaccggcgccagcggcttcatcggatcgaccctcgtcggcctcctcctcgaccgcggctacaacgtccacgccagcgtcctcaaccccgatgacaaggcggagacggagcacctggtcgccctgggcgccggcgccggcgagggccggctgcgagtcttcccgggcgacctcctcgacggcgccgcgctcatggccgccgcgcggggctgctcgggcgtgttccacctcgccaccccctgcaccgtctaccccgtgagcgacccgcaggggcagatggtggtgccggcggtggagggcacgctcaacgtcctgcgcgccgccaaggaggcccgcaccgtgcggcgggtggtggtcacctcgtccagctccgccatcatacccagccccgcgtggcccgccggcgagccccgcgacgagcggtgctgggccgacgtcgactactgcaagaagaacgaggtctggtaccctgtttccaagacgctggcagagaaggcggcgtggaggtttgcggaggagaacggggtagacgtggttgtcgtcaacccggtgactgccatgggcccaatgattccgcccaccatcaactgcagcatgatcgtgctcctacgcctgctacaaggttgcacggaggagtacagggacatctggatgggggcggtgcatgtgcacgacgccgccatggcgcatatcctggtgttcgagagcccggcagcgtccgggaggcacatctgcgcccagtccatctcccactggagcgacttcgcggccaaggtcgccgagctgtaccctgagtacaaggtgcccaattgcgtacgttgcaggttccccaaggatacccagcctgggctggtgcgacagggagccgaggaggggtccaagaagctcgtcgcgttggggctgcacttcagccctctggagaagatcatcagggacgctgtggaggccctcaagagcagaggctacatttcgtagctagccgaccgacggcagctatagtggagtagtatgcctgtcgaatttcgattcccaagtggcaaattctgcaaaacgagttcgccaatatgaacaataaataaagaacgttgtgataaaataaagcagattttctgttgc

SEQ ID NO: 96728 - protein, 336 aa, Zea mays
  misc_feature: Ceres CLONE 100845730
  misc_feature (11)..(258): Pfam Name: Epimerase Pfam Description: NAD dependent epimerase/dehydratase family
  misc_feature: SWISSPROT Homolog: EC 1.1.1.219 Dihydrokaempferol 4-reductase
MASVEGKRETVLVTGASGFIGSTLVGLLLDRGYNVHASVLNPDDKAETEHLVALGAGAGEGRLRVFPGDLLDGAALMAAARGCSGVFHLATPCTVYPVSDPQGQMVVPAVEGTLNVLRAAKEARTVRRVVVTSSSSAIIPSPAWPAGEPRDERCWADVDYCKKNEVWYPVSKTLAEKAAWRFAEENGVDVVVVNPVTAMGPMIPPTINCSMIVLLRLLQGCTEEYRDIWMGAVHVHDAAMAHILVFESPAASGRHICAQSISHWSDFAAKVAELYPEYKVPNCVRCRFPKDTQPGLVRQGAEEGSKKLVALGLHFSPLEKIIRDAVEALKSRGYIS

SEQ ID NO: 96729 - DNA, 1170 bp, Zea mays
  misc_feature: Ceres CLONE 100861679
  misc_feature: Encodes the peptide sequence at SEQ ID NO. 96730
ccccttccgcctacccacgcaaacggcacacgaactaacagccacctctcacgtcccccaccctctggttcatgtcctgctgctccccatgtcgcctccactcgagctcgactacataggcctctcgccgccggcggcagccgccgccgctgaaaacgacgaactgaagggtactgagctccgcctcgggctgccagggtccgggtcgccggaccgccgtgtcgtggctgccaccgcgaccaccctggacctgctcccggccaagggcgccaagcgcgggttttctgacgaggcgcccccgccatcgcctgttgccactgccggaaagggaaagaaggtggcagaagaggagtacgacgagaagaaggtggcagcgaccccgcagccggccgccaaagcacaggtggtgggatggccaccagtctgcaactaccgcaagaacacgatgactaccacccagctggagggcagcaaggaggatggtgatgccaagcagggtcaggggttcctgtacgtcaaggtcagcatggatggcgcgccgtacctcaggaagatcgacctcaagacttacaagaactacaaggacctgtcgaccgcgcttgagaagatgttcagtggcttcagtactggcaaggacggctcatctgagtaccgcaaggatggtgaatatgttctgacttacgaggacaaggatggagattggatgcttgtcggcgacgtaccatgggactgccacatcgtctttcgctccaattgtaggatgttcgccggctcctgccgcaggctcaggatcatgaaaggctcagatgcgattggactcgctccaagggcagccgataagtccaagaaccgcaactagaacggtggcttcctatccttacacagtccggtacgagggaggagatgcagtgacttgtaaggatctgtacgaaaaccgaaaaagtctactaacagctatgacttgtgagaagaattttggcttatggtctgcactagaatggcttggtacatcgtctatggacaaaacacgctattcgattaattgttgttaattaagccttggggggggtacgagtgctattcatgtaaatggtttggtgcatcgtgtgctgctgctgcctgctgctgttactacgattgagctcccctataatactatgatttgaagag

SEQ ID NO: 96730 - protein, 256 aa, Zea mays
  misc_feature: Ceres CLONE 100861679
  misc_feature (25)..(248): Pfam Name: AUX_IAA Pfam Description: AUX/IAA family
MSPPLELDYIGLSPPAAAAAAENDELKGTELRLGLPGSGSPDRRVVAATATTLDLLPAKGAKRGFSDEAPPPSPVATAGKGKKVAEEEYDEKKVAATPQPAAKAQVVGWPPVCNYRKNTMTTTQLEGSKEDGDAKQGQGFLYVKVSMDGAPYLRKIDLKTYKNYKDLSTALEKMFSGFSTGKDGSSEYRKDGEYVLTYEDKDGDWMLVGDVPWDCHIVFRSNCRMFAGSCRRLRIMKGSDAIGLAPRAADKSKNRN

SEQ ID NO: 96731 - DNA, 1221 bp, Zea mays
  misc_feature: Ceres CLONE 100863456
  misc_feature: Encodes the peptide sequence at SEQ ID NO. 96732
cgaatcgatctcccttccccaccaaaccggagcacttcggaggccggacccggcgagaagcgaccgaccgcagccagctcacgtctccctcttcatccaccatgctgagggtcgcgggcaggcgcctctcgtccgctctcgcctggcgccccgccgccgccgcctcaggctcccggggccctctcgccggtacactacccggccgcgacgacgacgacacacgcgactgcagggcgcgtttcgccatcgaatctcccttcttcgccgctgccagagagactcttgctccaagaaaccaggatgtgggcttatctgagctcccagcaactgtggcagctgtgaagaatccaagtggaaaaatcgtgtatgatgagtataaccatgagcgctacccacctggagaccccagcaagcgtgcatttgcctactttgtgctgagtggtgggaggttcatttacgcatctttgctgcgacttctcgtcttaaaatttgtcctaagcatgtcagcaagtaaggatgttctcgcgcttgcctcacttgaggttgacctctcaagcattgagcctggaaccacggtgacggtgaagtggcgtggcaagccggtcttcataaggcggaggacagaggatgatatcaagttggccaacagtgttgacgtcgcatccctccgccacccagagcaagatgcagagcgcgtcaagaaccccgaatggctggtcgtcattggggtctgcactcacctgggctgcatcccgctccctaatgcaggagactttggtggctggttctgcccgtgccacggctcgcactacgacatttctggtaggatccgcaagggcccggcacccttcaacctggaagtgccgacatacagcttcttggaagagaacaagcttctcatcggctgagattgctgttagtgttgttcgtgtcatcgtgtggccctgtcgtttttgtttgatcaacaacttcaccttttctcttgcctgggttagggcatacctttgtgggctgtttctgagtgcagtgttgttgctagcacctgacactaatgaataacctgatgctacataaaggatactgttaattgttgtcaaatttggttctgtttttttttcctgacagcaatgaacaatcttctgctactgaaagtatactgttaattgttttcaagtttgcttgtgttttttccctgatctcaagagggattgattatgtaac

SEQ ID NO: 96732 - protein, 268 aa, Zea mays
  misc_feature: Ceres CLONE 100863456
  misc_feature (168)..(264): Pfam Name: Rieske Pfam Description: Rieske [2Fe-2S] domain
  misc_feature: SWISSPROT Homolog: EC 1.10.2.2 Ubiquinol--cytochrome-c reductase
MLRVAGRRLSSALAWRPAAAASGSRGPLAGTLPGRDDDDTRDCRARFAIESPFFAAARETLAPRNQDVGLSELPATVAAVKNPSGKIVYDEYNHERYPPGDPSKRAFAYFVLSGGRFIYASLLRLLVLKFVLSMSASKDVLALASLEVDLSSIEPGTTVTVKWRGKPVFIRRRTEDDIKLANSVDVASLRHPEQDAERVKNPEWLVVIGVCTHLGCIPLPNAGDFGGWFCPCHGSHYDISGRIRKGPAPFNLEVPTYSFLEENKLLIG

SEQ ID NO: 96733 - DNA, 1294 bp, Zea mays
  misc_feature: Ceres CLONE 100867169
  misc_feature: Encodes the peptide sequence at SEQ ID NO. 96734
ggccgtctctcccgcagtcccgctgtccgcctgttccaacgcgctccgcgcacgcgcgcacacctacctaccccctgcgcttgcacaaaatccttcttgatccgcacaggaaggtcccggcagaagaacttggcgggcgaaaggcgaaaccgacgtgctcccgggcgggcggcgacagcggcatggagcgagagcggcaggcagtggcgaggaacaggaaggtggtgctgcgcgggtacatcgaccgcgcgcccagggaggaagacatggagctcgtcgacggcggcgccgtggagctgcgcgtccccgagggcggcggcggccccgcggtgctggtgaagaacctctacctatcctgcgacccttacatgcgcggcaggatgcgggacttccgcaactcctacatcccgcccttcaaacctggatcaggtttggcgtggggagggtggtcgactccactcatccaggattcagtgctggtgacgttgtttccgggatgactggatgggaggactacagtctgatcaccaagcctgaacagctcaggaagatccagcaaagcgacataccactctcctatcatctgggccttcttggcatgcctggctttacagcttatgttggattctatgagatctgttcaccaaagaaaggggagtttgtttttgtttctgctgcatcgggagcagttgggcaaattgttggtcaacttgcgaagctccatggttgctatgttgttggaagcgctgggacagatcagaaggttgagctcttaaaggaaaaattcggatttgatgcggctttcaattataaggaagagcctgacttgactgctgccctgaaaaggcacttccctgaaggcatagacatctacttcgagaacgtaggcgggccgatgcttgatgctgtactactcaacatgcgagtacatggccgcattgcggtatgtggcatggtttcccagcacggggtgactgctcctgccggaatccacaacctgttctccttgataagcaagaggatagagatgaaggggttcatccagagcgattacgtgcacctgttcccgcagttcgtcgatgacatcaccaggcattacagagacgggaagatcgtgtatgtggaagacatgagcgttgggctggagagtgggccggcttccttcgtcggtctgttcagcggtaaaaatgttggcaagcaggtcgtctgtgtgtcgcgggattgaaaggcctggattttgttccctactggccagtacccttaaataaaatcaggaaaacattattttcaactc

SEQ ID NO: 96734 - protein, 242 aa, Zea mays
  misc_feature: Ceres CLONE 100867169
  misc_feature (52)..(199): Pfam Name: ADH_zinc_N Pfam Description: Zinc-binding dehydrogenase
  misc_feature: SWISSPROT Homolog: EC 1.6.5.5 NADPH:quinone reductase
MTGWEDYSLITKPEQLRKIQQSDIPLSYHLGLLGMPGFTAYVGFYEICSPKKGEFVFVSAASGAVGQIVGQLAKLHGCYVVGSAGTDQKVELLKEKFGFDAAFNYKEEPDLTAALKRHFPEGIDIYFENVGGPMLDAVLLNMRVHGRIAVCGMVSQHGVTAPAGIHNLFSLISKRIEMKGFIQSDYVHLFPQFVDDITRHYRDGKIVYVEDMSVGLESGPASFVGLFSGKNVGKQVVCVSRD

SEQ ID NO: 96735 - DNA, 1263 bp, Zea mays
  misc_feature: Ceres CLONE 100868621
  misc_feature: Encodes the peptide sequence at SEQ ID NO. 96736
gttcctgtcgtggcccacatctagccgtcgtcgtcgtcaagaaaggaggcgccacaatgacgatgatggcgcctcatccgcagccactgccgctggcacagccgccggcgttcggggacaccacgctcaccaaggtgttcgtgggcggcctggcgtgggagacccacgagggcgccctccgcgggcacttccagcgctacggcgacatcctcgaggccgtcatcatctccgacaagctcaccggccgctccaagggctacggcttcgtgacgttcaaggaggcggacgcagccaagaaggcgtgcgaggatgccacccccgtcatcaacggccgtcgcgccaactgcaacctcgcctccctcggcgccaagccgaggccccagccgctgcagcacgtcctccgtccctcgcccccgcacgcgcacgcgcttccctctcctcaccagcccacgccagccatcgcggtgggatccaggagcgtgtcgccggtgccatggtactaccacccctccacgacgcgccctccgccgccgccggccgcgcaccagcagtaccacggcgtgctcccgttctaccccgccgccgccacctacgggtactccccgaactacgtcacggacctgagctacaatacgaaggtaggccaagcggcagctgccggcacggcggccgggtcctacctacagctacaggggcacttggcgtaccaggcggcgccagctcagggcggcatggtgccggtgtacccgttctaccactacccgtaccacgcctcgcactcgcagggcctgggcgtccccgccgcgcacttcctccccccggtctccgccgccgccgtcgtctcctccaagcccaccgtcgtggccactcccaaagcagtggagtggagcgggtgacgggttgcagctgaaggcacgaggcgatggtggtggtggcggcggcgactatgggcggcgcaatgaaaggcgctctgctctgttaacaagctgcacatgaagggtgtcggatgccgaagcgacgcaaggccgcattagttacattcattcaattccctctaacttcgaccacagtaccggcaacaacagtctgtaacaaacaaatgactggattcgtctctcgtttacctctgtatttttccaatggtaaacccgtttatcagtgtctgtagtgtagtagtccgatcgctgcaggtgacagcggacctcaataaaccgtcatagtatttcgccctattctatggtcgaaatatctcagttaaaaagt

SEQ ID NO: 96736 - protein, 279 aa, Zea mays
  misc_feature: Ceres CLONE 100868621
  misc_feature (27)..(97): Pfam Name: RRM_1 Pfam Description: RNA recognition motif. (a.k.a. RRM, RBD, or RNP domain)
MTMMAPHPQPLPLAQPPAFGDTTLTKVFVGGLAWETHEGALRGHFQRYGDILEAVIISDKLTGRSKGYGFVTFKEADAAKKACEDATPVINGRRANCNLASLGAKPRPQPLQHVLRPSPPHAHALPSPHQPTPAIAVGSRSVSPVPWYYHPSTTRPPPPPAAHQQYHGVLPFYPAAATYGYSPNYVTDLSYNTKVGQAAAAGTAAGSYLQLQGHLAYQAAPAQGGMVPVYPFYHYPYHASHSQGLGVPAAHFLPPVSAAAVVSSKPTVVATPKAVEWSG

SEQ ID NO: 96737 - DNA, 1323 bp, Zea mays
  misc_feature: Ceres CLONE 100872072
  misc_feature: Encodes the peptide sequence at SEQ ID NO. 96738
gctagtaccatcgtgcgagtgtgagcaagctactgagagaactcggaacgttgcttgacagcttgagtaggtaaataatctatggcgcgccaacagtggagcagcggcggcctcgcggtcgcggtgctggccgtgctgtcgtccgtgctcatctgctcgggccacccggtgccgggcgggctccccctgctgccgcacttctacggccacgcgtgcccgcagatggaggccatcgtggggtccctcgtggcgaaggcgcacgcggaggacccgcgcatggcggcgtccctgctgcggatgcacttccacgactgcttcgtgcagggctgcgacgcctccgtgctgctggacgccgacggcagcggcaggttcgtcaccgagaaacggtccaaccccaacaaggactcgctccgggggttcgaggtcatcgacgagatcaaggccgcgctcgagcacgcctgcccgcacaccgtctcctgcgccgacatcgtcgccgtcgccgccagggactccgtcgtcctgaccggcggacctggctgggaggtgccactggggaggagggactcgctgacggccagcctgagcggctccaacaacctcatccctgctcccaacgactccctccccaccatcatcggcaagttcgccaaccaaggcctcgacatcgtcgacctcgtcgcactctcaggggggcacaccatcggcgactcgcggtgcgtgagcttccggcagcggctgtacggccagaacaacaacgggcaggtggaccggacgctgaacccggcgtacgcggcggagctgcggggccggtgcccgcggtcgggcggcgaccagaacctgttcgcgctggacctggtgacccagttccggttcgacaaccagtactaccacaacatcctggccatgaacgggctgctcagctccgacgagatcctgctcacgcagagccgcgagaccatggacctcgtccaccgctacgccgccgaccagggcctcttcttcgaccacttcgccaagtccatggtcaagatgggcaacatctcgccgctcaccgggagcgccggcgagatcaggcacaactgcaggagggtcaaccacttctagcttccatggagtggccatccgtgcagtggtgttcttgctttggtttcatttctggatgcatgcgtcatctttcatacttggatttaagtgtgcagtagtcgtaaatgattggaatttctgttttagtttggtgcccattcgatctcgagtcgattttcactcatgtaatttgcaaatcttgtacgaagaaatgatccaataaaattcagcatttgtgtc

SEQ ID NO: 96738 - protein, 340 aa, Zea mays
  misc_feature: Ceres CLONE 100872072
  misc_feature (52)..(302): Pfam Name: peroxidase Pfam Description: Peroxidase
  misc_feature: SWISSPROT Homolog: EC 1.11.1.7 Peroxidase
MARQQWSSGGLAVAVLAVLSSVLICSGHPVPGGLPLLPHFYGHACPQMEAIVGSLVAKAHAEDPRMAASLLRMHFHDCFVQGCDASVLLDADGSGRFVTEKRSNPNKDSLRGFEVIDEIKAALEHACPHTVSCADIVAVAARDSVVLTGGPGWEVPLGRRDSLTASLSGSNNLIPAPNDSLPTIIGKFANQGLDIVDLVALSGGHTIGDSRCVSFRQRLYGQNNNGQVDRTLNPAYAAELRGRCPRSGGDQNLFALDLVTQFRFDNQYYHNILAMNGLLSSDEILLTQSRETMDLVHRYAADQGLFFDHFAKSMVKMGNISPLTGSAGEIRHNCRRVNHF

SEQ ID NO: 96739 - DNA, 1191 bp, Zea mays
  misc_feature: Ceres CLONE 100872347
  misc_feature: Encodes the peptide sequence at SEQ ID NO. 96740
cgaccacacccccgcaactgcagatccccaattcgtttatttcttcccaccgagccaagctgcgacgacggcggtcgcagcgtcgccttccctccctccgtaccgccgacgccgacgagcatattgggccgagcgcccgagcacctctcctgtcagcagcggcactcgccattccaagtacgaggtcgacgcgctgtggggcttgctgaaacgagcaggtctacccccaagtgaaatcagggtcttcaagatagcttactgagatgtggggttttgcatcaaacgcttgggcagctgggctggagaagaggagttccccaaaccgcacttcctcgagtgctgcttattctgacgacgaagcatcctcgtgcacaagcagggaagaaggcctggagtgcccgatatgttgggagtctttcaacatagtggagaatgtgccttatgcgctatggtgcggacacaccatgtgcaagaactgcatcctagggcttcaatgggccgtcatcaaagtcccaaccgtgccgatccagctaccgttcttcatctgctgtccctggtgcaacctcctgtcgccccgcgtactttacaaggggaacctcacgttcccacgaaagaactatttcctcctctggatggtcgaggggatgaacggcgagcgggccagatcacgcccagctattcgcagcgagcagcatactccgtggctctcaagcagcagcagcgtggcaaatggaaatgcaggctgttcaaatcccactcgacgccacctcccgccaccatctgttgacacttcgcccaccaacgcaaatcatgccaactacggggggtcccctctgctgaacgcagggagggtacaagcttcgctgcgcaaatccctgtcgttcctggtccacctgactgccaagtttcccctggtgttcgtcttcctcctcatagtgctgtatgcgatcccagccagcgcagcagtcctgttactgtatatccttatcactgtgctgtttgcgcttccctcgttcctgatactgtattttgcatatccgagcctggactggcttgttagagagatctttgcctgagattttttgttcggaaaaaaaaatctcaatgctgttgttggggtctgtgtaactgaattctccctagattttgttgcaagtgttgaagttattgccaagttttggttttggaccc

SEQ ID NO: 96740 - protein, 270 aa, Zea mays
  misc_feature: Ceres CLONE 100872347
MWGFASNAWAAGLEKRSSPNRTSSSAAYSDDEASSCTSREEGLECPICWESFNIVENVPYALWCGHTMCKNCILGLQWAVIKVPTVPIQLPFFICCPWCNLLSPRVLYKGNLTFPRKNYFLLWMVEGMNGERARSRPAIRSEQHTPWLSSSSSVANGNAGCSNPTRRHLPPPSVDTSPTNANHANYGGSPLLNAGRVQASLRKSLSFLVHLTAKFPLVFVFLLIVLYAIPASAAVLLLYILITVLFALPSFLILYFAYPSLDWLVREIFA

SEQ ID NO: 96741 - DNA, 1162 bp, Zea mays
  misc_feature: Ceres CLONE 100878243
  misc_feature: Encodes the peptide sequence at SEQ ID NO. 96742
ggctcttcccccgcacagcagcatctttcttctcctcttcgcggcgcgtcctccgggttaaggaaaaaaaagcggggaaaagggagaagaatcgcacgtcccgccgccgcccgctctgctagtgctagctgctgctggtttggtcgtttcccggccgccgcgccggtgacgcagatcgacagctcctgcccatctcagagtccatcgccgctgatcctgcctgtgcctgcgaaacacgcgcggggcaaggacggagctggtaagccgatcgagccggcgagggtggacaagatgatgatggccgaggtggtggccaaccacagcaaaaggagccacaccgacggctacttcagtgccaaagccgccgtcgccgccgccgccgccgcgagcccgccagaggagttgggaagcatgcccatgtcctcgaagaagccgaggccgaggaatagcaacagcccgagaaccgcgcccgtatcgcccaaggagaagaaggacaggatcggcgagagagtcgcggcgctccagcagctagtgtcgccgttcgggaagacagacacggcttccgttctgcaggaggcctcggggtacatcaggttcctgcaccagcagctccaggtcctcagctccccttacatgcgtgctcctccggctgccggcgccgcgcctgaggatcccgagcactacagcctccggagccgcgggctgtgcctggtgccggtggaccagacactgcagctgacccagagcaacggggccgacctgtgggcgccggcgaacacgaccaggcgcaggtgaggaggagcctgctgccggcctgtgcctggtggtggtctgcccggaggaaaccgcgcaagtactactgctgtgtttgcatggtgcgcgtgtagtacagtttccaagcgcctgacccaattcgatctcctaacaagaagctaagcattaagcaagcgtgtccgtatcagccgccttgtattataccagtgacctgtcggcgccgtatatgtgtgatttgcttgctagctgatccacacagatggaagcggccctgaactgcgtctccatgtggtactagtactatgtaactatgtgtttactgacttgtgaactagcagtctgtggcctgtcagcaagtaaatgggggcagtttaatgcatgttccttg

SEQ ID NO: 96742 - protein, 167 aa, Zea mays
  misc_feature: Ceres CLONE 100878243
MMMAEVVANHSKRSHTDGYFSAKAAVAAAAAASPPEELGSMPMSSKKPRPRNSNSPRTAPVSPKEKKDRIGERVAALQQLVSPFGKTDTASVLQEASGYIRFLHQQLQVLSSPYMRAPPAAGAAPEDPEHYSLRSRGLCLVPVDQTLQLTQSNGADLWAPANTTRRR

SEQ ID NO: 96743 - DNA, 978 bp, Zea mays
  misc_feature: Ceres CLONE 100881445
  misc_feature: Encodes the peptide sequence at SEQ ID NO. 96744
tcgggattgtgggcgagtgcgtgcgttcgtgcagccacagacaggcgtccgggcaccatgtctttcaccggcacgcaggacaagtgcacggcgtgcgacaagaccgtccacttcatcgacctcctcacggccgacggcgccatctaccataagacatgcttcaagtgcagccactgcaaaggggtcctctcgatgtgcagctactcctccatggacggtgtgctgtactgcaagacccacttcgagcagctcttcaaggagaccgggagcttctccaagaacttcacgccaggtggcaagtcatcagacaagggtgaactgacaagggccccaagcaagctgtcgtctgcattttctggtacccaggataagtgcgcagcatgccagaaaacagtgtacccgctggagaagttaactctggaaggcgagtcctaccacaagagctgcttcaagtgctcgcacggcggctgcatcctgaccacctcctcttatgccgcgctcaacggcgtcttgtactgcaagatccacttcgcgcagctgttcatggagaaggggagctacaaccacatgaacaagaagagcccgtcccaggaggttctgccggacgtggctgacgaggagcaaccgccggaaccagcgccaccgcaagatgagaaagaagaggacaactaggatcggagcgaccaacaaccacccatgcatatatatcacgcagactgaagtctacacgtttgccatatttctttacgacgacgacgcttctttattccctcctcccttttttttcctcttaatctctctgtgaacccggtttatcatcacgctgcaatcaagtgtgccagatgccttcgttacgtctgaggctcacgacaatggaaaatctgacatggacctgtcttagcctcgcggaaaaaaattgtaactttgtaagcagagccacttctttgaatatatgatcctaacaacgctgcccttaat

SEQ ID NO: 96744 - protein, 204 aa, Zea mays
  misc_feature: Ceres CLONE 100881445
  misc_feature (106)..(162): Pfam Name: LIM Pfam Description: LIM domain
  misc_feature (10)..(66): Pfam Name: LIM Pfam Description: LIM domain
  misc_feature: SWISSPROT Homolog: EC 2.7.11.1 Non-specific serine/threonine protein kinase
MSFTGTQDKCTACDKTVHFIDLLTADGAIYHKTCFKCSHCKGVLSMCSYSSMDGVLYCKTHFEQLFKETGSFSKNFTPGGKSSDKGELTRAPSKLSSAFSGTQDKCAACQKTVYPLEKLTLEGESYHKSCFKCSHGGCILTTSSYAALNGVLYCKIHFAQLFMEKGSYNHMNKKSPSQEVLPDVADEEQPPEPAPPQDEKEEDN

SEQ ID NO: 96745 - DNA, 1281 bp, Zea mays
  misc_feature: Ceres CLONE 100887352
  misc_feature: Encodes the peptide sequence at SEQ ID NO. 96746
ctgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccggttcagccccatcaaggagtccatcgtgtcccgcgagatgacccggcgctacatgacggacatgatcacccacgccgacaccgacgtggtgatcgtgggcgccgggtccgcgggcctgtcctgcgcgtacgagctgtccaaggaccccaccgtgagcgtggccatcgtggagcagtccgtgtccccgggcggcggcgcgtggctgggcgggcagctgttctcggccatggtggtgcgcaggccggcgcacctgttcctggacgagctgggcgtgggctacgacgaggccgaggactacgtggtggtcaagcacgcggcgctgttcacgtccaccgtgatgagccggctcctggcgcggcccaacgtgaagctgttcaacgccgtggcggtggaggacctgatcgtgcggcgggggcgcgtcggcggcgtggtcaccaactgggcgctcgtgtccatgaaccacgacacgcagtcgtgcatggaccccaacgtgatggaggccaaggtggtggtcagctcctgcggccacgacgggcccttcggcgccaccggcgtcaagaggctccaggacatcggcatgatcagcgccgtgcccgggatgaaggcgctcgacatgaacgccgccgaggacgagatcgtgcgcctcacgcgcgaggtcgtgcccggcatgatcgtcaccgggatggaggtcgccgagatcgacggcgccccgaggatgggcccgacgttcggcgccatgatgatctccggccagaaggcggcgcacctggcgctgaaggcactgggcaggcccaacgccgtggacggggtttttttttttaatttgggactttgttgttgttggacgaatgaattcccttcgatcggttagctttaatctgtctcgttagtgtgtcgtgttcgtgtagcaccatgccacagctacgccatgccgtgtgctttgtcacgtgggggccactcgtggggtctcctgctgctgtcagaacgaataagagaagatggaattgtggtgaaacaataaaaatgcatggtttaaattgt

SEQ ID NO: 96746 - protein, 350 aa, Zea mays
  misc_feature: Ceres CLONE 100887352
  misc_feature (62)..(304): Pfam Name: Thi4 Pfam Description: Thi4 family
MATTAASSLLKSSFAGSRLPSATRTTTPSSVAVATPRAGGGPIRASISSSPTPPYDLTSFRFSPIKESIVSREMTRRYMTDMITHADTDVVIVGAGSAGLSCAYELSKDPTVSVAIVEQSVSPGGGAWLGGQLFSAMVVRRPAHLFLDELGVGYDEAEDYVVVKHAALFTSTVMSRLLARPNVKLFNAVAVEDLIVRRGRVGGVVTNWALVSMNHDTQSCMDPNVMEAKVVVSSCGHDGPFGATGVKRLQDIGMISAVPGMKALDMNAAEDEIVRLTREVVPGMIVTGMEVAEIDGAPRMGPTFGAMMISGQKAAHLALKALGRPNAVDGVFFFNLGLCCCWTNEFPSIG

SEQ ID NO: 96747 - DNA, 1156 bp, Zea mays
  misc_feature: Ceres CLONE 100889267
  misc_feature: Encodes the peptide sequence at SEQ ID NO. 96748
tgcgaccgaagctagctagcagctcttcttgctttgcattaattattgcgagatgacgatgtccattgttgctgccgtgctgctgttgctgctcgtccatgtccatccacgggcggcagcggcgcaaccttcgccgggctacttcccgagctccacagtgaggcccatggccttctcggatggatacgacaacctgtgggggccgcagcaccagacgctgtcgcaggacaggatggcgctgacgctcttgatggaccgcacctcaggcagcgggttcaagtccaagcgctcgtaccggaacggctacttcggcgtctccatcaaggtgcagccgggctacaccgccggcgtcaacaccgccttctacctgtccaacaacgagctgtaccctgggaggcacgacgagatcgacatggagctgctgggcaccgtgccgggggagccctacacgctgcagaccaacgtgtacgtgcggggcaccggcgacggcgcgcgcctcgtggggcgggagatgcgcttccacctctggttcgacccggccgccgacttccaccactacgccatcctctggaaccccgaccagatcgtcttcctcgtcgacgacgtccccatcaggcgctacgccgccgccagtgcgccgttcttccccgaccgccagatgtgggcgtacggctccatctgggacgcctccgactgggccaccgacggaggccgctacagggccgactacagctaccagcccttcctggcaggattccgggggttcaggaccgccggatgcgaggccgccgcgcccgcccagtgccgtcccgtgccggcgtcccccgccggcgccggacttagcgtgcagcagcgggacgccatgcgctgggcgcagcagacctccatggtctactactactgccaggattacaccaaggatcgctccttgtacccagagtgctcgctcgctagctagcctagctagcactaccactaccagagcatgcatggaggaggcgtgcgagtgaagaagcgccgccctacgtacgtaccgttctaaaattgtatgtacaattaagtctccatccacatccatatatacaacatatgtaatgtataattaagtccattattaatttaatcatcaaaaatggaacatgcctatatatttcct

SEQ ID NO: 96748 - protein, 301 aa, Zea mays
  misc_feature: Ceres CLONE 100889267
  misc_feature (41)..(228): Pfam Name: Glyco_hydro_16 Pfam Description: Glycosyl hydrolases family 16
  misc_feature (251)..(297): Pfam Name: XET_C Pfam Description: Xyloglucan endo-transglycosylase (XET) C-terminus
  misc_feature: SWISSPROT Homolog: EC 2.4.1.207 Xyloglucan:xyloglucosyl transferase
MTMSIVAAVLLLLLVHVHPRAAAAQPSPGYFPSSTVRPMAFSDGYDNLWGPQHQTLSQDRMALTLLMDRTSGSGFKSKRSYRNGYFGVSIKVQPGYTAGVNTAFYLSNNELYPGRHDEIDMELLGTVPGEPYTLQTNVYVRGTGDGARLVGREMRFHLWFDPAADFHHYAILWNPDQIVFLVDDVPIRRYAAASAPFFPDRQMWAYGSIWDASDWATDGGRYRADYSYQPFLAGFRGFRTAGCEAAAPAQCRPVPASPAGAGLSVQQRDAMRWAQQTSMVYYYCQDYTKDRSLYPECSLAS

SEQ ID NO: 96749 - DNA, 1283 bp, Zea mays
  misc_feature: Ceres CLONE 100889852
  misc_feature: Encodes the peptide sequence at SEQ ID NO. 96750
ctctcacatcatcatcatatctctttaccccttcttcccagcgacaagagaaaggattagaaaaaggaaagatccatggacatgatctccggcagcactgcagcaacatcaacaccccacaacaaccaacaggcggtgatgttgtcatcccccattataaaggaggaagctagggacccaaagcagacacgagccatgccccaaataggtggcagtggggagcgtaagccgaggccgcaactacctgaggcgctcaagtgcccacgctgcgactccaacaacaccaagttttgctactacaacaattatagcatgtcacaaccacgctacttttgcaaggcttgccgccgctattggacacatggtggtaccctccgcaatgtccccattggtggtgggtgtcgcaagaacaaacatgcctctagatttgtcttgggctctcacacctcatcgtcctcatctgctacctatgcaccattatcccctagcaccaacgctagctctagcaatatgagcatcaacaaacatatgatgatggtgcctaacatgacgatgcctaccccaacgacaatgggcttattccctaatgtgctcccaacacttatgccgacaggtggaggcgggggctttgacttcactatggacaaccaacatagatcattgtccttcacaccaatgtctctacctagccaggggccagtgcctatgctggctgcaggagggagtgaggcaacaccgtctttcctagagatgctgagaggagggatttttcatggtagtagtagctataacacaagtctcacgatgagtggtggcaacaatggaatggacaagccattttcgctgccatcatatggtgcaatgtgcacaaatgggttgagtggctcaaccactaatgatgccagacaactggtggggcctcagcaggataacaaggccatcatgaagagcagtaataacaacaatggtgtatcattgttgaacctctactggaacaagcacaacaacaacaacaacaacaacaacaacaacaacaacaagggacaataaggttagtgtgccagaccgtggaagcgttgctgctataaataatgcaattgggtagtagtacccagtgaaatcaggagagactagtagcctagggtgcattttgatttatttagttttggtcaagatgacaagtcatcatgaatcaccctttttattcatttgcatgttttgatgagagttcatttgcagtaagctatatatcattggataattaatcatttggttggatcatc

SEQ ID NO: 96750 - protein, 324 aa, Zea mays
  misc_feature: Ceres CLONE 100889852
  misc_feature (55)..(117): Pfam Name: zf-Dof Pfam Description: Dof domain, zinc finger
MDMISGSTAATSTPHNNQQAVMLSSPIIKEEARDPKQTRAMPQIGGSGERKPRPQLPEALKCPRCDSNNTKFCYYNNYSMSQPRYFCKACRRYWTHGGTLRNVPIGGGCRKNKHASRFVLGSHTSSSSSATYAPLSPSTNASSSNMSINKHMMMVPNMTMPTPTTMGLFPNVLPTLMPTGGGGGFDFTMDNQHRSLSFTPMSLPSQGPVPMLAAGGSEATPSFLEMLRGGIFHGSSSYNTSLTMSGGNNGMDKPFSLPSYGAMCTNGLSGSTTNDARQLVGPQQDNKAIMKSSNNNNGVSLLNLYWNKHNNNNNNNNNNNNKGQ

SEQ ID NO: 96751 - DNA, 1382 bp, Zea mays
  misc_feature: Ceres CLONE 100890755
  misc_feature: Encodes the peptide sequence at SEQ ID NO. 96752
cgagctcacccttccgcctgccgcctgaacttgtctcgcccgcggcagatctgctccttccgctcgctgcaccgcaacccggataggagaccgcgcgcggtcgagaactacctggggaccaacgtcctcgaccagctccggtgcggccggcacacagctccacagctggactcatcgcccatggagcacactaagtcaggccccagcagttggccagaactggccgacgtggtgccggtgccgcaggacgatgggcctagccctgtggtgtccatcgcctatcgagatgactttcgtgaggtcatggattacttccgcgccctctacctcaccggtgagcgaagccctcgcgctctccgcctcaccgccgaggccatcgagctcaaccccggcaactacactgtctggcatttccggcgccttattctggagtcactagattttgatttactagaggagatgaaatttgtcgaaaaaattgctgaatgcaatccaaaaaattaccaaatctggcaccataagagatggcttgctgagaaattaggacctggtattgcaaacaaagagcatgaattcacaatgaagatacttgctattgatgcaaaaaattatcatgcttggtctcataggcagtgggttcttcaagcgttggggggatgggagactgaattagaatactgtgaccacttacttaaggaagacgtcttcaataattcagcttggaatcagagatactttgttataacaagatcaccatttcttggtggccttgcggcaatgcgtgattcagaagtagactacacaattgaagctattctagcaaacgctcagaatgaaagcccctggaggtacctcaagggtctatacaagggtgagaataacctgctagtagaggacgagcgcatctttgctgtttgtttcaaggtcctgaagaatgattggacttgtgtatttgctttgagtttgctgctcgatcttttctgcactggtttgcagccttcagatgaacttaggtccactcttgaaacaataaggagctcccatcctgaaaccgcggatgatgatcctgcagccgctgtttgctgtatcctgcagaaatgtgatcccctgcgggtaaattattggtcttggttcaaggacactctttttcagatttcatgacttcacatgggttcaccccttgtccgcgctggtccgggctctgtgagatagacatgttttagatagtttcattggacacccaaacagagcggacagagtgtatggctgctaccttttccgtgactgaaagcagtgcttgtaacgattttgtttagtaaaatttgtgagtgttactgctccaaacaacaccttatgcaaccatatttgaatatttcacatgt

SEQ ID NO: 96752 - protein, 326 aa, Zea mays
  misc_feature: Ceres CLONE 100890755
  misc_feature (92)..(122): Pfam Name: PPTA Pfam Description: Protein prenyltransferase alpha subunit repeat
  misc_feature (128)..(158): Pfam Name: PPTA Pfam Description: Protein prenyltransferase alpha subunit repeat
  misc_feature (57)..(87): Pfam Name: PPTA Pfam Description: Protein prenyltransferase alpha subunit repeat
  misc_feature (162)..(192): Pfam Name: PPTA Pfam Description: Protein prenyltransferase alpha subunit repeat
  misc_feature: SWISSPROT Homolog: EC 2.5.1.60 Protein geranylgeranyltransferase type II
MEHTKSGPSSWPELADVVPVPQDDGPSPVVSIAYRDDFREVMDYFRALYLTGERSPRALRLTAEAIELNPGNYTVWHFRRLILESLDFDLLEEMKFVEKIAECNPKNYQIWHHKRWLAEKLGPGIANKEHEFTMKILAIDAKNYHAWSHRQWVLQALGGWETELEYCDHLLKEDVFNNSAWNQRYFVITRSPFLGGLAAMRDSEVDYTIEAILANAQNESPWRYLKGLYKGENNLLVEDERIFAVCFKVLKNDWTCVFALSLLLDLFCTGLQPSDELRSTLETIRSSHPETADDDPAAAVCCILQKCDPLRVNYWSWFKDTLFQIS

SEQ ID NO: 96753 - DNA, 1288 bp, Zea mays
  misc_feature: Ceres CLONE 100891638
  misc_feature: Encodes the peptide sequence at SEQ ID NO. 96754
gttcacaaattatatgcaatcgcaagcgagcagaatggcgaggtccagtggtagtagaccagtggccctcgtgctgctggcgctgtgcgccgccgccctctcgtcggccacggtgaccgtgaatgagcccatcgccaatggcctctcctggagcttctacgacgtttcctgcccgtcggtggagggcatcgtgcgctggcacgtcgccgaggccctccgccgcgacatcggcatcgccgcggggctcatccgcatcttcttccacgactgcttcccgcagggctgcgacgcgtccgtcctcctgtctggttccaacagcgagcagatcgaggtacccaaccagacgctgcgtcccgaggcgctcaagctcatcgacgacatccgcgccgccgtccacgccgtctgcgggcccacggtgtcctgcgccgacatcaccacgctcgccaccagggacgccgtcgtcgcgtccggcggccccttcttcgaggttcctctcgggcggcgcgacggtctggcgccggcgtcaagcgacctggtgggcaccctgccggcgcccttcttcgacgtgccgacgctgatcgagtcgttcaagaaccggagcctggacaaggcggacctggtggcgctgtccggcgcgcacacggtgggccgcggccactgcgtctccttcagcgaccggctgccgcccaacgcggacgacggcaccatggacccggcgttccggcagaggctgacggctaagtgcgccagcgaccccagcgggaacgtggtgacccaggtgctggacgtgcgcacgcccaacgccttcgacaacaagtactacttcgacctcatcgccaagcaggggctcttcaagtcggaccagggcctcatcaaccacccggacaccaagcgcgcggccacccgcttcgcgctcaaccaggccgccttcttcgaccagttcgccaggtccatggtgaagatgagccagatggacatcctcaccggcagcgcgggagagatccgccgcaactgctccgtgcgcaacaccgccctcggagatgtctcatcgtcagcccaccagctcgagaccaccgccggcgacgaggggctcgcggccgacgcgtgaaatgatgattagctgctgttgttttttctctggtctccttcgattctgttgaaataaggcttgctgcatcatcggtatagtttgcattcttctacccatcaatatggtatatcttcctgtgtcagccccgtgattaccatgcagaccaacgcgtgagcatctatatgtcttaacaatatc

SEQ ID NO: 96754 - protein, 357 aa, Zea mays
  misc_feature: Ceres CLONE 100891638
  misc_feature (53)..(295): Pfam Name: peroxidase Pfam Description: Peroxidase
  misc_feature: SWISSPROT Homolog: EC 1.11.1.7 Peroxidase
MARSSGSRPVALVLLALCAAALSSATVTVNEPIANGLSWSFYDVSCPSVEGIVRWHVAEALRRDIGIAAGLIRIFFHDCFPQGCDASVLLSGSNSEQIEVPNQTLRPEALKLIDDIRAAVHAVCGPTVSCADITTLATRDAVVASGGPFFEVPLGRRDGLAPASSDLVGTLPAPFFDVPTLIESFKNRSLDKADLVALSGAHTVGRGHCVSFSDRLPPNADDGTMDPAFRQRLTAKCASDPSGNVVTQVLDVRTPNAFDNKYYFDLIAKQGLFKSDQGLINHPDTKRAATRFALNQAAFFDQFARSMVKMSQMDILTGSAGEIRRNCSVRNTALGDVSSSAHQLETTAGDEGLAADA

SEQ ID NO: 96755 - DNA, 1419 bp, Zea mays
  misc_feature: Ceres CLONE 100893668
  misc_feature: Encodes the peptide sequence at SEQ ID NO. 96756
gaaaccaacctcgctaggctagctaaccacaagaaagatcgcgcgctgcgagaggcgccggccatgagttcctgcgtcgccccccgcgttctcatcgtgtcgcgtcgcactgtccgcaagaacaagttcgtcgacttcgtcggtgagtaccacctggacctcatcgtgggctacggcgcggtgccggtgatcgtgccgcgcgtggcgggcgtggacgcgctgctggactcattcgagcccatccacggcgtgctcctctgcgagggcgaggacgtcgacccgtccctttacgagtccgctgacgacgccgacggctcgctctctccggagcagctggaggccatgcggcgcctgcacccgagcgacgtggccatcgaccgcgagaaggactccatcgagctccgcctcgcgcgccgctgcctcgagcgtaacatcccctacctcggcatctgccgcggctcgcaggttctcaacgtcgcctgcggcgggtcgctgtaccaggacctggagcacgaactggttcggcccgccgcgcaggtccagcacatcaactacggcgactacgacgggcaccgccacccggtgcgcgtcctgtccggcacgccgctgcacgagtggttcgcgcgcgatctcgctgacggcgcgcagttgatggtgaacagctaccaccaccagggcgtgcggcggctggcgcagcggttcgtgcccatggcgatcgcaccggacgggctcgtcgaggggttctacgacccggacacgtacaaccccggcgagggcaggttcatcgtgggcctccagttccacccggagcgcatgcgcaagcccggctccgacgagttcgactaccccggctgcgccagggcgtaccaggagttcgtccgcgccgtggtcgcgtaccaggagaagacggcggttccgccgcacctgcccctcagcgcacccctccccgcgtcaccgaagctgagcaaggagatgatgaggcggcgcaaggtcatcccccggagcttctcgctcgccatggacatgtacctatccgacagccacaccaagccggcggagaagcgcgaccacgaagccggcgccgagttcctcgagtcgaacacggcgtcggtgagcgcgtggcaggagaagcggctgaagcagatgggcgccacggcgcggaacgcgtcggggtacctcaacggcgtcaaggtgaacggcgtacgcgaggcggcggcgcgggcactcatggcggagatgagcgtgaaccagctatccgacctcgccaccttctaccagaccatgggcaagatctgttttgaggtgtttgacaccaagctgcagggttagcacccgaaaatgaatctgcagaatgaagactgagcgtgaagtatagcaaatacatgatgttattggacgataaatcaatgttgttaagcc

SEQ ID NO: 96756 - protein, 421 aa, Zea mays
  misc_feature: Ceres CLONE 100893668
  misc_feature (7)..(249): Pfam Name: Peptidase_C26 Pfam Description: Peptidase C26
  misc_feature: SWISSPROT Homolog: EC 3.5.1.94 Gamma-glutamyl-gamma-aminobutyrate hydrolase
MSSCVAPRVLIVSRRTVRKNKFVDFVGEYHLDLIVGYGAVPVIVPRVAGVDALLDSFEPIHGVLLCEGEDVDPSLYESADDADGSLSPEQLEAMRRLHPSDVAIDREKDSIELRLARRCLERNIPYLGICRGSQVLNVACGGSLYQDLEHELVRPAAQVQHINYGDYDGHRHPVRVLSGTPLHEWFARDLADGAQLMVNSYHHQGVRRLAQRFVPMAIAPDGLVEGFYDPDTYNPGEGRFIVGLQFHPERMRKPGSDEFDYPGCARAYQEFVRAVVAYQEKTAVPPHLPLSAPLPASPKLSKEMMRRRKVIPRSFSLAMDMYLSDSHTKPAEKRDHEAGAEFLESNTASVSAWQEKRLKQMGATARNASGYLNGVKVNGVREAAARALMAEMSVNQLSDLATFYQTMGKICFEVFDTKLQG

SEQ ID NO: 96757 - DNA, 1366 bp, Zea mays
  misc_feature: Ceres CLONE 100899353
  misc_feature: Encodes the peptide sequence at SEQ ID NO. 96758
cccgattcacctcctgggaaagtggaagggagggagaagcaaggcaaagcggagccgagggtcaaaggccctcgtcctgcttggccaagcaagcgtcgcgcacgtacgtagaggccgaccggccggccaggttgaagaaggcatggggaggccgccgtgctgtgagaaggccgggttgaagaaggggccctggtcgccggaggaggacctcttgctcgtctcctacgtgcaggagcacggtcctgggaattggcgcgccgtgccatgcagcaccggtctgatgcgctgcagcaagagctgccggctccggtggaccaactacctccgcccgggcatcaagcgcggcagcttcagcgaccaggaggagaagctcatcatccacctccaggagctgctcgggaacaagtggtccgcgattgcgtcgtacctgccggagcggacggacaatgacatcaagaactactggaacacgcacctcaagaagaagctcgccaagacgggcgccagggaaagcggtgccagcgccaagacgacgaagaagagcgatagggccgcggcgcccaaggggcagtgggagcggcggctgcagacgaacatccacaccgcacgccaggcgctccgggaggcgctgtccatggacgacactgcgccgccggcaatcaagccggagccgctgccgctgccgctggggcagctgccggcgccagccagccaggcgatgtacgcttccagcatcgataacatagcgcgtctgctggagggctggatgcgtcccagcgtcagtgggaatgcgtcggctgagtccatgtcctccttctcggcgttctccggtggtggcgacggcgcgtcggcaagccacatcggcacggcgcacacgccggaggggttcaccggcacgagaaaggaagagggcgcggggccggggccggcgtcattaccaatgttcgagaactggctgctcgatgacggcatggggaacggtgatgcgtccctcatctgcgtcccgctggcggacccgtgcgagttcttttagactgaactggagggggataaggaaaaacagaataaaagtgctaggctggaagaagaagaagaaagaagccaggaactcgattccctgataatatagatcgacacagtgcaatgctggtcttgatatatatagtatagttgttcaatccagttccttgcttcttatttctatgaatttggattttttttttttattctcttttttgtttacaaaatttgggtttgggcttggtcttgttatgtatgtccatagttatcagtcctacacaggatgatggattatgattcatcatgatgtgtgcattagaagcaaaaaaaaagaaatctacttttt

SEQ ID NO: 96758 - protein, 296 aa, Zea mays
  misc_feature: Ceres CLONE 100899353
  misc_feature (67)..(112): Pfam Name: Myb_DNA-binding Pfam Description: Myb-like DNA-binding domain
  misc_feature (14)..(61): Pfam Name: Myb_DNA-binding Pfam Description: Myb-like DNA-binding domain
MGRPPCCEKAGLKKGPWSPEEDLLLVSYVQEHGPGNWRAVPCSTGLMRCSKSCRLRWTNYLRPGIKRGSFSDQEEKLIIHLQELLGNKWSAIASYLPERTDNDIKNYWNTHLKKKLAKTGARESGASAKTTKKSDRAAAPKGQWERRLQTNIHTARQALREALSMDDTAPPAIKPEPLPLPLGQLPAPASQAMYASSIDNIARLLEGWMRPSVSGNASAESMSSFSAFSGGGDGASASHIGTAHTPEGFTGTRKEEGAGPGPASLPMFENWLLDDGMGNGDASLICVPLADPCEFF

SEQ ID NO: 96759 - DNA, 1386 bp, Zea mays
  misc_feature: Ceres CLONE 100899581
  misc_feature: Encodes the peptide sequence at SEQ ID NO. 96760
cagcacgcagcacgcagcaccagccaccacaccacccgtcacgtcactactgctccttcctttgtcctctcctgcctcacgtttcacgccagcagaagcgccaaacaccagcagcggacgaccacgccaactctaggtctacgaggaaggagggggggagggaggagcagcgcagcggcagccgatggtgtcgatgagctcgacgccgtaccctctggatccgtccgtcccggccgtcgtggggggcagcaaggaggaggaggaggaggcggtggagtcttgtgccgccgccgccgccacgcccttgccgccggttgggatcgacgacgacgaggagggcccccggagagtgcgcaagccctacaccataaccaagtcgcgcgagagctggaccgaccccgagcacgacaagttcctcgaggcactgcagctcttcgaccgtgactggaaaaagattgaagcatatgttggctccaagacagtaatacagattaggagtcacgcacagaagtactttttgaaggttcaaaagaatggaactggtgagcatttgcccccgcctaggccaaagcgaaaggctgcccatccatatccgcacaagtcctcaaaaaaggcccttcaagttgtcttaccacaacaagtttcgcacataatggagcaaggctgtggtacaccaatggatgtagctactgttgctacagactctaatgtaaataatgcttttcctgttcaacatttcagtccgaggcatacacaagccatgccagactttgctcgtgtatacaacttcctgggaagcatatttgatccagagacaaatgggcatttgcagaagttgaaggaaatggatcccattgatgctgaaacggtacagttgctgatgaaaaatctgtcaatcaacctaactagtccaaactttgaggagcataggaggttgctctcttcggaagcctcaagaagcatggatcaagagtcgggctcttcccgcgttcatctcccgttcatgataacgagcaagtgagagaagcagctggctggcctgaagccaagaaggtcgtttggagtcgtcacactcaggagcaaggcgatgcgtatgtacatatatcttaataagcagctttaggatagcttggtttgctcgacccacatgttgcaagtttatgcgcctttttctttattctttgcgcccctccagttttgcccattgtagtatggaacttataacatgcgtgctttatgccgcatcttacaaattttttttgtcccatcacaaggatgaacgggtggggcatgtgtgtgtgtgtttttttgccgtgtgtatatgtatacagcatgtggctgtatgtgtagatcagactatatatataacagactgtgtgctattct

SEQ ID NO: 96760 - protein, 278 aa, Zea mays
  misc_feature: Ceres CLONE 100899581
  misc_feature (66)..(111): Pfam Name: Myb_DNA-binding Pfam Description: Myb-like DNA-binding domain
MVSMSSTPYPLDPSVPAVVGGSKEEEEEAVESCAAAAATPLPPVGIDDDEEGPRRVRKPYTITKSRESWTDPEHDKFLEALQLFDRDWKKIEAYVGSKTVIQIRSHAQKYFLKVQKNGTGEHLPPPRPKRKAAHPYPHKSSKKALQVVLPQQVSHIMEQGCGTPMDVATVATDSNVNNAFPVQHFSPRHTQAMPDFARVYNFLGSIFDPETNGHLQKLKEMDPIDAETVQLLMKNLSINLTSPNFEEHRRLLSSEASRSMDQESGSSRVHLPFMITSK

SEQ ID NO: 96761 - DNA, 1305 bp, Zea mays
  misc_feature: Ceres CLONE 100905600
  misc_feature: Encodes the peptide sequence at SEQ ID NO. 96762
caagtcatcagctagctagccttccctacagcaactgcttacatacaacacttccatcttcccgagctcgtcttcgatcaattcccaagtcaaataataatataacaacaatggtggttcccgtcatcgacttctccaagctggacggcgctgagagggccgaaaccctggcgcagatcgccaatggctgcgaggagtggggattcttccagctcgtgaaccacggcatcccgctggagcttcttgagcgcgtcaagaaggtgagctccgactgctaccgcctccgggaggccgggttcaaggcgtcggagccggtgcgcacgctggaggcgctcgtcgacgcggagcggcgcggcgaggttgtggcgccggtggatgacctggactgggaggacatcttctacatccacgacggatgccagtggccgtccgagccgccggcgttcaaggagaccatgcgcgagtaccgcgccgagctgaggaagctcgccgagcgcgtcatggaggccatggacgagaacctcggcctcgccaggggcaccatcaaggacgccttctccagcggcggccggcacgagcccttcttcggcaccaaggtcagccactacccgccgtgcccgcgcccggacctcatcacgggcctgcgcgcgcacaccgacgccggcggcgtcatcctgctgttccaggacgacagggtcggcggcctggaggtgctcaaggacggccagtggaccgacgtgcagccgctcgcgggcgccatcgtcgtcaacactggcgaccagattgaggtgctcagcaacgggcgctaccgcagcgcctggcaccgcgtgctgcccatgcgcgacggcaaccgccgctccatcgcttccttctacaacccggccaacgaggccaccatctcgccggcggcggtgcaggccagcggcggcgacgcataccccaagtacgtgttcggcgactacatggacgtgtacgccaagcacaagttccaggccaaggagcccaggttcgaagccgtcaaggttgcagcgcccaagtcatctccagcggcataaataaatggaggggaccaattattaaatgcattataatttatttgttgaataaaacagccggagaaataatgataatgtaaagtatatatgataaaccccggttaggatttaaggtgtttaactttagttgcatggtataatatgatatattgttgtagcaataagtttattaagtattcataagtgttctaaatagtgggctaaggcacttatccatcgcctttctcaaacagaaaatagtgatttaatt

SEQ ID NO: 96762 - protein, 314 aa, Zea mays
  misc_feature: Ceres CLONE 100905600
  misc_feature (157)..(257): Pfam Name: 2OG-FeII_Oxy Pfam Description: 2OG-Fe(II) oxygenase superfamily
  misc_feature: SWISSPROT Homolog: EC 1.14.17.4 Aminocyclopropanecarboxylate oxidase
MVVPVIDFSKLDGAERAETLAQIANGCEEWGFFQLVNHGIPLELLERVKKVSSDCYRLREAGFKASEPVRTLEALVDAERRGEVVAPVDDLDWEDIFYIHDGCQWPSEPPAFKETMREYRAELRKLAERVMEAMDENLGLARGTIKDAFSSGGRHEPFFGTKVSHYPPCPRPDLITGLRAHTDAGGVILLFQDDRVGGLEVLKDGQWTDVQPLAGAIVVNTGDQIEVLSNGRYRSAWHRVLPMRDGNRRSIASFYNPANEATISPAAVQASGGDAYPKYVFGDYMDVYAKHKFQAKEPRFEAVKVAAPKSSPAA

SEQ ID NO: 96763 - DNA, 1220 bp, Zea mays
  misc_feature: Ceres CLONE 100916110
  misc_feature: Encodes the peptide sequence at SEQ ID NO. 96764
caacagatgatgaagctggtgctctccctgcagatcccccaatcaccggatgagtgagccagcaccggcagctgcaactgtgagtctgtgaccagcatcaccacccactgcgcaagagctaaagaatccaggctccaactcccacaattgcgagaaccaaagctaagctagctgctataactccacccaagctaagctgatccatggacatgccgccgaaccccgacagcccctcgtcaggagggagcaacagcatcggccggccgagtggcggcggcgcatcgccgtccgtcggttctacgatgccgcagtcgtcgccgagccggtacgaggcgcagaagcggcgcgactggaacacgttcggccagtacctgcggaaccaccggccgccactgagcctggcgcagtgcagcggggctcacgtcctcgagttcctccgctacctggaccagttcggcaagaccaaggtgcacggcccggcgtgccccttcttcggccacccgaacccgccggcgccgtgcccctgcccgctccgccaggcctggggcagcctcgacgccctcgtgggccgcctccgcgccgcctacgaggagaacggaggccgcccagagtccaatcccttcgccgcgcgcgccgtacgcctctacctctgcgaggtccgcgagcaccaggcccgcgcccgcggcgtcagctacgagaagaagaagcgcaggaagccgcagcagctgccgggcccgggcgacagcagcggccttcacggccacgcgcaccagccgccgcctccaccgcccgcgggcgccgcctgctgagctagctgatcgatccaccgctctttcgtgcgctctcccattcggccggtatgatgccagccagattgagcttgagcatgctcatatattttatgtatcattccgtgcgcgtatgcatgcatgtgcatggcgcagtgtagccatgcagctccatgctgctgatccgtctactctacctacctgctgctgagtgtaccgcattgcttgtctttatctgtgtttcgattcgatttagcattggtgttgtcgaatctatttgcttgtaggagtgagcaagtgtttgctgtactgtcaactgagtatatatgtccctttgagatctactagctagggactgggagatacatatatggtgatctctcttgctgtttctgttcgtggaaaatttaaaagcctgcgtagtgtgtgtcc

SEQ ID NO: 96764 - protein, 201 aa, Zea mays
  misc_feature: Ceres CLONE 100916110
  misc_feature (23)..(155): Pfam Name: DUF640 Pfam Description: Protein of unknown function (DUF640)
MDMPPNPDSPSSGGSNSIGRPSGGGASPSVGSTMPQSSPSRYEAQKRRDWNTFGQYLRNHRPPLSLAQCSGAHVLEFLRYLDQFGKTKVHGPACPFFGHPNPPAPCPCPLRQAWGSLDALVGRLRAAYEENGGRPESNPFAARAVRLYLCEVREHQARARGVSYEKKKRRKPQQLPGPGDSSGLHGHAHQPPPPPPAGAAC

SEQ ID NO: 96765 - DNA, 1208 bp, Zea mays
  misc_feature: Ceres CLONE 100916946
  misc_feature: Encodes the peptide sequence at SEQ ID NO. 96766
gatcggacaaggcgccggagcctcagcaatccctgagcagactagaggagtagctaaggcaaagggaggtggcaaagatgctgccgacgaccgcgtccaaggggcgcggggcctcccgctccgccccgccgctcttcggtccctacctccgccgcatcgtcaagtggcaacaaatggatattgaatacacattttggcaaatggttcatctctgtacttcaccaaaagtagtctatcagcacaccaaatatcacaagcaaacaaagaaccagtgggcccgtgatgatcctgcatttgttgttattctgattcttttcctcgtgtttgcaacatcagcttactgtgcagcatatggagagagtgcctcacatgctgctctaacaatcacttcggttgtgtttctccatttcttgtttgctgggatagttttggccacactttgctggttccttacaaattcttacttgagagaggaacctaacagccatgttgttgagcaacgcgtggagtgtgcacacgaaattcttggcaggctctatgcatttgacgttcattgtaactcgttctttcctgcgtttgtcatcctatatgtggtgcagtattttctgtcgcctctattggtcgcgcatggcttctttccagctttgttatctaatctactcttcgtggtggcaatttcttattatcactacctgaactttctaggatatgatgttcttccatttctggatagaacaacattcttcctgtacccgattggtctcgtcatcatcctgtctccacttatgatactaatagggttcaatccgacaagatattttttaagcttgtacttcggttaaagtctacggctagaatgccatgtacaagcaaaaatatggtgattggcgataactaatggcagatctggatacatactctgtagtaaagcattttagatattttgtgtgaacgggggcgagtgaagttcagtaaagctcggagcattctatggatgtatcaggtgcctgtggcaaggctaacaatggaagacatatagtcttttgattgttatcaaatatcctttttgggtgtcaatttgttgttcataatatgagctgtttgcgttactttgggcccagtgaccagtgtatacttgtagtagaactgctacgtagagtctattgtactatcacatcggcatcagaattgcatcaagttctaccacc

SEQ ID NO: 96766 - protein, 254 aa, Zea mays
  misc_feature: Ceres CLONE 100916946
  misc_feature (17)..(254): Pfam Name: UNC-50 Pfam Description: UNC-50 family
MLPTTASKGRGASRSAPPLFGPYLRRIVKWQQMDIEYTFWQMVHLCTSPKVVYQHTKYHKQTKNQWARDDPAFVVILILFLVFATSAYCAAYGESASHAALTITSVVFLHFLFAGIVLATLCWFLTNSYLREEPNSHVVEQRVECAHEILGRLYAFDVHCNSFFPAFVILYVVQYFLSPLLVAHGFFPALLSNLLFVVAISYYHYLNFLGYDVLPFLDRTTFFLYPIGLVIILSPLMILIGFNPTRYFLSLYFG

SEQ ID NO: 96767 - DNA, 1089 bp, Zea mays
  misc_feature: Ceres CLONE 100921885
  misc_feature: Encodes the peptide sequence at SEQ ID NO. 96768
ctcctagccccagctagatctttggacacatatcgaaacagctctagctagcgcgctcgtcgtctaacctggcttccggcatggcttccaagcagatcggagtcttgacctgcttcattgccatcaccgctctcgccttccgtccctgcgcatccgccgtgcccatggacggtggctggtcgaacggcggcgccacctggtacggcccagccaagggcgctggatccgacggtggtgcgtgtgggtaccagggtgccgtcgaccagcctccgttctcgtcaatgatcaccgccggcagccaatccatcttccaggacggcaagggctgcggcacctgctaccaggtgaagtgcaccggccacgagtcgtgctccggcagcccggtgacagtggtcatcaccgacctgtgccccgacgctacgtgccaggtggagcccgtccacttcgacctgagcgggacggcgttcggtgccatggcgaagcccggccaggccgacaagctccgaaacgccggccgcctacaagtccagtacactcgggtggcgtgcaactggaacggcttggacatcgccttcagggtggacgccggctcaaacgccaactacctggccatggccatcgagtacgagtccggggacggggacctgcgcgccgtggagctgaagcagagcggcgcggcggcgtgggcgcccatgcaacgctcctggggcgctgtgtggcagtacaagtccggctccaccaatctgcaggcccccctgtctgtccgcctcacctcgggctccggcagggtcctcgtcgccagcaacgtcatccccgccggatggcagcccggcagaacctaccgctccgtcgtcaacttcggaggaaaccatgcataacgagtggtattaagatatcgatcgtctgcagatgtctccatccaacaataagatgcatgcatatatgatctgtgtggccagctagctgctagatcatctcacttcctgagtgggctgatgctcagccaataaagaatcattccatctgtatcggaaattcaacatatataataatgcaagcaccggaaataaaattttactgtgttctggg

SEQ ID NO: 96768 - protein, 265 aa, Zea mays
  misc_feature: Ceres CLONE 100921885
  misc_feature (69)..(151): Pfam Name: DPBB_1 Pfam Description: Rare lipoprotein A (RlpA)-like double-psi beta-barrel
  misc_feature (163)..(245): Pfam Name: Pollen_allerg_1 Pfam Description: Pollen allergen
  misc_feature: SWISSPROT Homolog: EC 3.2.1.4 Cellulase
MASKQIGVLTCFIAITALAFRPCASAVPMDGGWSNGGATWYGPAKGAGSDGGACGYQGAVDQPPFSSMITAGSQSIFQDGKGCGTCYQVKCTGHESCSGSPVTVVITDLCPDATCQVEPVHFDLSGTAFGAMAKPGQADKLRNAGRLQVQYTRVACNWNGLDIAFRVDAGSNANYLAMAIEYESGDGDLRAVELKQSGAAAWAPMQRSWGAVWQYKSGSTNLQAPLSVRLTSGSGRVLVASNVIPAGWQPGRTYRSVVNFGGNHA

SEQ ID NO: 96769 - DNA, 1320 bp, Zea mays
  misc_feature: Ceres CLONE 100922468
  misc_feature: Encodes the peptide sequence at SEQ ID NO. 96770
ctccgctacccccagccaagtcgctcccggtggctccgttctccgcgccttcgttccccctcggttttcctgctgtttcgcctcggtcctgcttgctggtgctgcagatctgcgttcgccggccccttctccctgctatcgcatgccagccaggcgcccacgggcacggccagcccccaccccacaggcgtggcactgcccctgtccggctgttccttgcttttgcttgcctgtgcctgctcctgttgggcttcggcacctgcacagaggagacagaggtatacagagccacgcagccaaggatttcgaattcgtgacttgttggagtttctgaatggccagcccaggggatgcggagggcatcaccatctccatgggggagctgagcgtagaagcagcgacttcgtcagctaacggcggtggtgatgttgccgctgtcgaccaggatgatgtgtgggaagatgtttcagattctcatgggcacgcgtctaccttagacagagaatggatccacaggcagaaccagtttcaaaagatgggctatcgggacggaataacacaagggcagaaggactctgcccaggaaggcttcaatgctgggttcaggcaatctgtaaacgctggctacaagtggggccttgttcgcggggttgccagtagtgcgctagccaatcttccagacagcttgaaagagaaactggtgccggacgtccagtgcagagggaaactacaggatctgcacagctccgtgcgagaaatatcagcagatgacgctctccagatgttccacgagagtatccgccagagtaaccctccgtcagaggggtcaggatcatatgtagtagcatcagccaccgatggagctacggaaccaaacaggatgaaaagcctaccgaaggatctcgtgttgttgctgcgtgaatgctcggatatcaaagtcagcaaggagttggcgtgggattcatgaacaaggcgactcagaaattccaaccactacaagtgtggcagaatcacactgagttcccagattactgaacgcctgcctgggctgatggatgaatgtgattcggggattttgttttggaagtgactgagatactcgaaaggttcagggacctcgaatcgaatgtgtctgtagtaatgcagatttttattccatatttcccttttttttgctgcaacctgtaactagaattgtaactataaatttgcagttcttaaacaattgtaatgtttttttttctctccctgaattctgtcatcttcctgaacaatggtcttcatgtggaagtatagtattttgccacgttttgagccgac

SEQ ID NO: 96770 - protein, 210 aa, Zea mays
  misc_feature: Ceres CLONE 100922468
MASPGDAEGITISMGELSVEAATSSANGGGDVAAVDQDDVWEDVSDSHGHASTLDREWIHRQNQFQKMGYRDGITQGQKDSAQEGFNAGFRQSVNAGYKWGLVRGVASSALANLPDSLKEKLVPDVQCRGKLQDLHSSVREISADDALQMFHESIRQSNPPSEGSGSYVVASATDGATEPNRMKSLPKDLVLLLRECSDIKVSKELAWDS

SEQ ID NO: 96771 - DNA, 1179 bp, Zea mays
  misc_feature: Ceres CLONE 100925409
  misc_feature: Encodes the peptide sequence at SEQ ID NO. 96772
cagtccgtcagtgtggtggtcagagagaaaagatgaaaaaaaagaataattcattggagccgcacgtctccttccggccttccccgacgatgccgctgccgccgggaggaacggatggatcccattggcttgccaccaccactgcccgcttcggttcctattcccgctcgctacggccccagtcgcgctcctcaccggccggcaccaccccgcccgccctcgccttttgcctgccgagatttaggcctggcattctagcaatgcagaagaagtgatcttataatcataaaagataacaatggggatatccaaggtgaccggcatctctgcgacagcttttcttgtcacatctgttggtctgtaccagctcggcatgagaattattgtgcttcctttcctagccaccagtattgttgcttctgttgtcactgttgcatcccatgatgccatcaacctaccgtggatcctggggaagaactcagtgggaaggtttcctctttggtcagttatactgtttggtcctttcttgacgcttgctcggacatatgcaatggttaagagatacatgaggaaagagtccgtgtatgacaagattgtggatggcctatatcttggaggatggccctttctcttgaaacatttgccccctggaaacccatctgtcatagactgcacttgtgagcttccaagaatttccttcgttccagcagacgagtatctttgtcttgcaacttgggataccagagctccaacaccataccaaattgaaaaagctgcacgttgggcttgtggaaagagatctgaggggaagccggtttatgtccattgcgcatttggtcatggaagaagtgcttgtgtcgtgtgtgcaattctagtagcgctgggcattgctgagaactggaaagaggctgagaacatcatccgtgaaagaagaaagataaaaatgaacgcccttcacaggaaaaccttggaagagtggtccaaacaacgggattctcagaaaaaggctaagtagttgtaagtgtaacattttccttagagataaacttgtttgtggtgttaaagcttgtttgaaacatcatacaatggcatatctacttaggccaagtgtaatgtctgtgaaattattattattattttctcggtgtttctacctttaaacatatttgatttatatcc

SEQ ID NO: 96772 - protein, 238 aa, Zea mays
  misc_feature: Ceres CLONE 100925409
  misc_feature (98)..(230): Pfam Name: DSPc Pfam Description: Dual specificity phosphatase, catalytic domain
MGISKVTGISATAFLVTSVGLYQLGMRIIVLPFLATSIVASVVTVASHDAINLPWILGKNSVGRFPLWSVILFGPFLTLARTYAMVKRYMRKESVYDKIVDGLYLGGWPFLLKHLPPGNPSVIDCTCELPRISFVPADEYLCLATWDTRAPTPYQIEKAARWACGKRSEGKPVYVHCAFGHGRSACVVCAILVALGIAENWKEAENIIRERRKIKMNALHRKTLEEWSKQRDSQKKAK

SEQ ID NO: 96773 - DNA, 1127 bp, Zea mays
  misc_feature: Ceres CLONE 100928642
  misc_feature: Encodes the peptide sequence at SEQ ID NO. 96774
gcaacgcaagtcggaagaggaatctctccaagctccaatcctccgatcctgccccaacccaagtcccctccaccaggccgcacacctccgccgcccggcgcgaccttgcatccaccagcctgccctctccttcgcgtgaggcggccccggcgaccgcgtcggcagtgcaagaccagaccgaggcttctcccgttggaaggttccagccatggcgagcgccgatctgctgcggaaggaggaggagttctactcctccctctttgattccgcaaaaggcgacggcgtcaagtcgcgctcgcaggtgattgagaggaagattgaatccctcgaggacatggccaccaaggtcagcaaccggagatcaagaagatggttgaacgaccgcttgctgattgagcttgtcccacgccttcatgttgaagaaatcaaaggcctctttgctcctccaccatggggtgaggagctgcccttgtcagcattctgcaggacaagtgttagtgactgggaggccttcaggagcatcgacatggatgctgaggcaagattgatgcaacacatgaaacgatcatccgaaaaacaaaggactcatgtcgacgaagatgaattgattgctctgaatgcttggcgtcgtataggtcgccaaacaagagaagctattaagaaaaaatttctacctgatctacttcaaatatatgaagaacaggttagggccttcattgaaggtactggtgacagcgacgtgcttgtgctgaatgtccaggacccgttccagaggctgcttctgcacggtgtttgtgagttttataacgtaacctcaatgaccacaagcagtgtaagggacgggaagccatggaagagcacccccatcaagaagaggcatgtcaccggtcttcctccgagaatcacattagttagcttcctgaggatgaggaagaattagtcgtcccagtaacatgtggatgtgagggtcctacactaattcgcctggatgtgtactaaaaagacaaatttgttgctttaggtcgcatttagcatgtaatcaaatgtaaaatatccatgtcaaatgtaaaatacattgcaagcccttgttccagatgaagaaactcaaaagtgtaagcccctacttc

SEQ ID NO: 96774 - protein, 243 aa, Zea mays
  misc_feature: Ceres CLONE 100928642
MASADLLRKEEEFYSSLFDSAKGDGVKSRSQVIERKIESLEDMATKVSNRRSRRWLNDRLLIELVPRLHVEEIKGLFAPPPWGEELPLSAFCRTSVSDWEAFRSIDMDAEARLMQHMKRSSEKQRTHVDEDELIALNAWRRIGRQTREAIKKKFLPDLLQIYEEQVRAFIEGTGDSDVLVLNVQDPFQRLLLHGVCEFYNVTSMTTSSVRDGKPWKSTPIKKRHVTGLPPRITLVSFLRMRKN

SEQ ID NO: 96775 - DNA, 1274 bp, Zea mays
  misc_feature: Ceres CLONE 100936644
  misc_feature: Encodes the peptide sequence at SEQ ID NO. 96776
ccctgccacccaaccttgcttcttctccgatagctatttctctgctttctctccaatcttcccgggtttccctgattaaagatggctgaatcctttgttctcagtaccggctcgaggatcccatcggttgggcttggcgtatggcaaatacaacctgacgctgccaacgacgccatctacgctgctgtcaaggctgggtatcggcatattgactgtgcagcagcatacaacaatgaggaggaggtgggcctggctttgaagaaattatttgaagatggtgtggttaagcgtgatgatttgtttatcacctctaagctatgggctgctaatcatgcacctgaagatgtggaagagggaatcgacaccacacttcaagatttgcagcttgactacttggacttgtacctcatccatggtccaatccgcatcaaaaaaggaactagcacgatgacccctgaaaactttctccctacagatatccctgctacatgggcagcgatggagaagttatacgactctggcaaagctcgtgcaatcggcgtgagtaacttctcttgtaagaagctgcatgatttgcttgccgttgcacgagtgcctccagcagtcaaccaggttgagtgtcatccggtttggcagcaagacaagctccggaagctatgccaatccaatggtgttcatctttctgcattctcgcctttaggctcacctggatctccttggatcaatgggccaagtgtcctcaagaaccccattgtggtctttgttgcagacaagttgcagaaaacgcctgcccaggtcgctctacgctggggaatccaaatgggccatagtgtactcccgaaaagcgccaatgagtccaggattaaggagaacattgacatatttggctggtctattcctgaagatttgatggccaagttctttgaaatcaaacaggtcaggctgctgacagctgagtttgtagttcaccctcaggccggctacaatacattggaggacttttgggatggtgaaatataaaagcatacaaatttgttcagaataaaagagccaggcgaggaaacaaccacaaaaaaggggagatcgaatgcataggccccaatacgatgaatttgggggtttacgtgattgctgaacacaagtattgtgtgactaatctgtgttttgatgtggtaaatgtaattgggttagtcacaataagagataagtgtctttgccacaagacttttggttcattggttgaagcatgatgtaaaccgtaaaggatattcatg

SEQ ID NO: 96776 - protein, 312 aa, Zea mays
  misc_feature: Ceres CLONE 100936644
  misc_feature (7)..(285): Pfam Name: Aldo_ket_red Pfam Description: Aldo/keto reductase family
  misc_feature: SWISSPROT Homolog: EC 1.1.1.21 Aldehyde reductase
MAESFVLSTGSRIPSVGLGVWQIQPDAANDAIYAAVKAGYRHIDCAAAYNNEEEVGLALKKLFEDGVVKRDDLFITSKLWAANHAPEDVEEGIDTTLQDLQLDYLDLYLIHGPIRIKKGTSTMTPENFLPTDIPATWAAMEKLYDSGKARAIGVSNFSCKKLHDLLAVARVPPAVNQVECHPVWQQDKLRKLCQSNGVHLSAFSPLGSPGSPWINGPSVLKNPIVVFVADKLQKTPAQVALRWGIQMGHSVLPKSANESRIKENIDIFGWSIPEDLMAKFFEIKQVRLLTAEFVVHPQAGYNTLEDFWDGEI

SEQ ID NO: 96777 - DNA, 943 bp, Zea mays
  misc_feature: Ceres CLONE 100936982
  misc_feature: Encodes the peptide sequence at SEQ ID NO. 96778
ccagcaatccggccgcggccaggcagccaccagcagcgacaagaaatcgagaatcctcgtttcccattttgtggctggcgcgagcgtgcagcgtcacaggtttccggacggacgctttctatcgcaatcctatctatatatttatcccaaggcttcgtggtttttgttgctgctgctgctgtcacggccgccttccactcccacaagcttcagctagccttcttactcccgccgtcacccccgatccgagagcgagcatggcgcactctctcgccgcctccttctcgccggccgccgcccggcgccaggtcacaaatgtgattccaagctggacctcggtttccttccagagccacaggatgacttctgtatccatccgctcaagacaaaggtctcttgggtttaagatttgctgttcggctaagaaagagacagtggacaaggtttgcagtatagtgaaggagcagctggctcttcccgatgggaccgccatcactgccgaatcaaaattcgctgaacttggcgctgattcgctggatacggtcgagattgtgatgggcctcgaggaggcgttcaacataacagtcgacgaaacaagcgcacaggacatcgcaacagtgcaggacgctgcggaccttatcgagaagctcatgctggaggcacctccaaaggtcgtctagatccagcaaccttgcgatcgacgaccttgtgtttgatctatgttgtgtgttaatttgttcgtgttgccccatttgttctttcttgatgattcaagatgaggttttgtattggtgttgctgaggtgaattagatagccccaaaggccacatgaagcagatgaggacagttcattccactttgaatttgtatgttgtaacttgtagtgctgctatagagaaaccaatggactgttatgaagagtcaatgcaactgttgctttttt

SEQ ID NO: 96778 - protein, 140 aa, Zea mays; identical to SEQ ID NO: 77279
  misc_feature: Ceres CLONE 100936982
  misc_feature (61)..(128): Pfam Name: PP-binding Pfam Description: Phosphopantetheine attachment site

SEQ ID NO: 96779 - DNA, 1243 bp, Zea mays
  misc_feature: Ceres CLONE 100941070
  misc_feature: Encodes the peptide sequence at SEQ ID NO. 96780
tgcagatccccaattcgtttatttcttcccaccgagccaagctgcgacgacggcggtcgcagcgtcgccttccctccctccgtaccgccgacgccggtgagtctccgacgccgagacctctcccatttctgtgattccagcgcttccccttacaaccattgcggccctgccccgctttgtttcagacgagcatattgggccgagcgcccgagcacctctcctgtcagcagcggcactcgccattccaagtacgaggtcgacgcgctgtggggcttgctgaaacgagcaggtctacccccaagtgaaatcagggtcttcaagatagcttactgagatgtggggttttgcatcaaacgcttgggcagctgggctggagaagaggagttccccaaaccgcacttcctcgagtgctgcttattctgacgacgaagcatcctcgtgcacaagcagggaagaaggcctggagtgcccgatatgttgggagtctttcaacatagtggagaatgtgccttatgcgctatggtgcggacacaccatgtgcaagaactgcatcctagggcttcaatgggccgtcatcaaagtcccaaccgtgccgatccagctaccgttcttcatctgctgtccctggtgcaacctcctgtcgccccgcgtactttacaaggggaacctcacgttcccacgaaagaactatttcctcctctggatggtcgaggggatgaacggcgagcgggccagatcacgcccagctattcgcagcgagcagcatactccgtggctctcaagcagcagcagcgtggcaaatggaaatgcaggctgttcaaatcccactcgacgccccctcccgccaccatctgttgacacttcgcccaccaacgcaaatcatgccaactacggggggtcccctctgctgaacgcagggagggtacaagcttcgctgcgcaaatccctgtcgttcctggtccccctgactgccaagtttcccctggtgttcgtcttcctcctcatagtgctgtatgcgatcccagccagcgcagcagtcctgttactgtatatccttatcactgtgctgtttgcgcttccctcgttcctgatactgtattttgcatatccgagcctggactggcttgttagagagatctttgcctgagattttttgttcggaaaaaaaaatctcaatgctgttgttggggtctgtgtaactgaattctccctagattttgttgcaagtgttgaagttattgcc

SEQ ID NO: 96780 - protein, 270 aa, Zea mays
  misc_feature: Ceres CLONE 100941070
MWGFASNAWAAGLEKRSSPNRTSSSAAYSDDEASSCTSREEGLECPICWESFNIVENVPYALWCGHTMCKNCILGLQWAVIKVPTVPIQLPFFICCPWCNLLSPRVLYKGNLTFPRKNYFLLWMVEGMNGERARSRPAIRSEQHTPWLSSSSSVANGNAGCSNPTRRPLPPPSVDTSPTNANHANYGGSPLLNAGRVQASLRKSLSFLVPLTAKFPLVFVFLLIVLYAIPASAAVLLLYILITVLFALPSFLILYFAYPSLDWLVREIFA

SEQ ID NO: 96781 - DNA, 1343 bp, Zea mays
  misc_feature: Ceres CLONE 100949181
  misc_feature: Encodes the peptide sequence at SEQ ID NO. 96782
caccgccacagcagcctcggcgctgcgtttctgccttcccggtgagacaaatggccgccagcgccaccgacgccgacgccggcgccgggctcagatcggagttcctgcaggtcctgctcagccgccgccgcgatctcctagtgcctctcacggtggagcaagggagtccggtgaaggacccgatgtaccagaatcctccgtcgaccatggaggcaaatccgatggagtcgtgccccagtaaagaggtggagaacttgagggagaagctggttgaagaaaatttctaccttatcactgagctaggtgaacaaggacgagtacctgtacttctgctgaagcttgacgaccccgtccctagaagaaaaccagctatcgtgttcctgcacagctcttacaagtgcaaagagtggctgcgcccactgcttgaggcatatgcttccaagggctacgtctgtgtggctattgactcgcgctatcacggcgaaagggccagcaatgaaaccacttacatagatgcactgaaatcggcttggcggaatggggatacaatgcctttcgtttttgacacggtgtgggacttggtaaagcttggagactacctcggcgagagggaggacgtggatccctgtagggttgggatcaccggcgaatcgctgggagggatgcacgcgtggtttgctgcttttgtggacacacggtacagtgtcgtcgttcctatcatcggtgttcagggattcaggtgggccattgacaacaacatgtggctggctagggtgaatagcataaggcctttatttgaagaagcaagaattgacttaggaaagagcgaattagatacagaagttgttgaaagggtttgggaaaagatagcaccaggcctggactcgcaatttgatgccccctattcacttcctttgcttgcaccacggccgttgctacttctaaatggcgctgaagatcctcgttgcccaataagtggtttaggagaagctatttcaaaaactgctaaagcttacgaagaatctggttgcgcggagaagttcatgttcattgcagagcctggagtcggccataaaatcacaatcgacatggtgaaggcagcaagcgaatggttcgatcgcttcctgcatgcatgaatgcaaaagttattgtcgcccatcatttgttctatatcgattgtgatttgtcaacagcatcccttagttgaagtatttatgtcctcgtctgtgtaccttggtaattgccggtcggacaaacatctctatctctatttattatattaggatacgtttggttgctggacaaatgagggcagaatagaatggctcctaagttgggaatgg

SEQ ID NO: 96782 - protein, 361 aa, Zea mays
  misc_feature: Ceres CLONE 100949181
MAASATDADAGAGLRSEFLQVLLSRRRDLLVPLTVEQGSPVKDPMYQNPPSTMEANPMESCPSKEVENLREKLVEENFYLITELGEQGRVPVLLLKLDDPVPRRKPAIVFLHSSYKCKEWLRPLLEAYASKGYVCVAIDSRYHGERASNETTYIDALKSAWRNGDTMPFVFDTVWDLVKLGDYLGEREDVDPCRVGITGESLGGMHAWFAAFVDTRYSVVVPIIGVQGFRWAIDNNMWLARVNSIRPLFEEARIDLGKSELDTEVVERVWEKIAPGLDSQFDAPYSLPLLAPRPLLLLNGAEDPRCPISGLGEAISKTAKAYEESGCAEKFMFIAEPGVGHKITIDMVKAASEWFDRFLHA

SEQ ID NO: 96783 - DNA, 1299 bp, Zea mays
  misc_feature: Ceres CLONE 100950897
  misc_feature: Encodes the peptide sequence at SEQ ID NO. 96784
gagcagctgtcgcttttgacctatcggggggcgccgggcgggcgtaacggaaccaaggcggccaggtagctgctgtgctgctacgagtagtaagcactatatatataacgggcaacggcaaagccatcgtcgtcgtcgtggaactcgtacttgcgtgcgtgcgcacaagaacgcgggtcagagctgctggcggttggaggagcagaggagatcgctgtgcgggcggcgatggagaagccccggcaggtggcgcggaaattcctggcccggccgcagcacgagggcgccggcgccgtcgtccgccgcagcatcggcaggttcgagctgaggtacttcgacccgttccttgtcctcgacgagttcacagtttctgctccggccggcttccccgaccacccgcaccgaggcttcgagaccgtcacctacatgcttgagggcgccgtgacgcacgaggacttcgagggccaccgtggcaccatcaaggccggcgacgtgcagtggatgacggccggccgcggcatcgtgcactccgagatgcccgccggccccggcacgtccaggggcctgcagctctgggtcaacctctcctccgccaacaaaatggtcgagcccgggtaccaggagatccagagcaaggacatcgcgtgcacgtccgacggcgacggcggcgtcacggtgcgcgtgatcgccggccacgccatgggcgtgcgctcgccggtgcgcacgcgcacgccgaccatgtacctggacttcacggtgcgcccgcgcggcgcggtgcggcagcccgtgcgcgcgtcctggaacgccttcgcctacgtgctggagggcgagggcgtgttcggcgccgagcggtgcgcgcccgtcggcgcccaccacctgctgctgttcggccacggcgacggcctcgaggtttggaacaagttgcccgaccgcccgctccgcttcctgtttgtcgccggcgagcccatcggggagcccgtcgcgcagctcggccccttcgtcatgaacaccgaggaggagatcgacatgaccgtcaacgacttcgagtgctacgccaatgggttcgagaaggcccgccactggaagtcgcaggcgatgctggcgcttggcgtagagtagggcgagacatgagcacaggatccccaaagaaaacgaatagatttttttttgcttcttttttccccattattatcgttccggtttgttgcgttcaattttaacccccaacattggatcgctttgtgtacatatctgccgtaaattatttttttatcaataacgaaattaccagctgttcat

SEQ ID NO: 96784 - protein, 296 aa, Zea mays
  misc_feature: Ceres CLONE 100950897
  misc_feature (21)..(117): Pfam Name: Pirin Pfam Description: Pirin
  misc_feature (172)..(278): Pfam Name: Pirin_C Pfam Description: Pirin C-terminal cupin domain
MEKPRQVARKFLARPQHEGAGAVVRRSIGRFELRYFDPFLVLDEFTVSAPAGFPDHPHRGFETVTYMLEGAVTHEDFEGHRGTIKAGDVQWMTAGRGIVHSEMPAGPGTSRGLQLWVNLSSANKMVEPGYQEIQSKDIACTSDGDGGVTVRVIAGHAMGVRSPVRTRTPTMYLDFTVRPRGAVRQPVRASWNAFAYVLEGEGVFGAERCAPVGAHHLLLFGHGDGLEVWNKLPDRPLRFLFVAGEPIGEPVAQLGPFVMNTEEEIDMTVNDFECYANGFEKARHWKSQAMLALGVE

SEQ ID NO: 96785 - DNA, 1351 bp, Zea mays
  misc_feature: Ceres CLONE 100953299
  misc_feature: Encodes the peptide sequence at SEQ ID NO. 96786
caaaccaacacggcaacacccattccggcagcggcaggcatctcctctcccgccccgccccgagcaacgcccgctaggctcaggctgctgctacccgcagtccccatccaccctacccgcagtccccaccgcaaccgccgcctcggcccgggctgtgttgacccccgttgacctccgccagcccggccgtcatggacctgcgcttcccgccgccggcgccgtcgtcctgcttcggcgggggcggtgtgctcccggcacgggggcaccaccggcgggcgcaatcggagacgttcatccggctgcccgacgcggacctcctgctggacccggatgccgacttcggcttctccgacatcgacttcccctcgctgtccgacgactcgcccgcggcgtccgacccgacgccgcagccgcaggccccgccaccccagcagccgcttccgcaggcggcttcgccggcgtctgcggcgccgccgaggccgccgagcggagcgcacatgcggagcctctccctcgacgccgccttcttcgacggcctctcgctacagggaggcgggggcgtggcggggcacaagaggagcggctctatggacggggccacctcgccgttcgagggcgagtccgcgccgacgtccgtgctgccggactacgccaagaaggccgtgcccgacgacaggctcgccgagctcgcgctcctcgaccccaagcgcgccaagaggatcctggcgaaccggcagtctgcggcgaggtccaaggagaggaagatcaagtacaccagtgagctggagaggaaggtgcagacgctgcagacagaggccaccacactttcggcacagctcacgcttcttcagagggacacctctggtttaaccactgagaacagggagctgaagctccggctgcaggccatggaagaacaagctaaactccgagatgctttaaatgacgccctgagagaagaagtccagcggcttaagatagccacagggcaggtccctaacataaacgggaatcccttcaacggaggactaccccagcagcagcaggtgccgagctatttctcacaaccacaggggatgcaatacttcagcagccaccagggccagcatcagcatccgaaccatcaccctcagagttcttcaaacggtggtggccagtccttgagtgactccatggatttcatgtgaggaccgaaggagagacagctcaggagttgcctgagatcacataccaactaaagtactgtaaaaaggttgctgatgtataccatattcagtattattatgatacgcgtcattgtaggttagctagctgttccttgtaccattaatcagaagttcattcatgcatg

SEQ ID NO: 96786 - protein, 331 aa, Zea mays
  misc_feature: Ceres CLONE 100953299
  misc_feature (170)..(231): Pfam Name: bZIP_1 Pfam Description: bZIP transcription factor
MDLRFPPPAPSSCFGGGGVLPARGHHRRAQSETFIRLPDADLLLDPDADFGFSDIDFPSLSDDSPAASDPTPQPQAPPPQQPLPQAASPASAAPPRPPSGAHMRSLSLDAAFFDGLSLQGGGGVAGHKRSGSMDGATSPFEGESAPTSVLPDYAKKAVPDDRLAELALLDPKRAKRILANRQSAARSKERKIKYTSELERKVQTLQTEATTLSAQLTLLQRDTSGLTTENRELKLRLQAMEEQAKLRDALNDALREEVQRLKIATGQVPNINGNPFNGGLPQQQQVPSYFSQPQGMQYFSSHQGQHQHPNHHPQSSSNGGGQSLSDSMDFM

SEQ ID NO: 96787 - DNA, 1436 bp, Zea mays
  misc_feature: Ceres CLONE 100955348
  misc_feature: Encodes the peptide sequence at SEQ ID NO. 96788
gcaaatccagcgggtccgtactcatctgcttcacctccgggctccggctacggcggcactcttctctggcaaccggtcggaagatgttggatcttccgcttcaaatcgacgcataaaggatgcagattagttttgttcgcgtcaaatttattttgctcggtgtagttctgtccattaattaattatttgtactggatttaaggtgctgctattttgaaggttttttctcccggaaattttcacatcccgaaacgactggaaattgaagtagccatttgatgctgttacctgggttcataagttgttagacttgttgttatttgtttgttaatcctatagctattgcatattgtgtgcctgatcaggaccacagaaacctctaggcgacgaatcgagcaggtagaggagtaatcaggcatccatggctgagcatcttgcgtccatctttggcacggagaaggaccgcgtgaactgccccttctacttcaagatcggcgcatgccgccacggcgaccggtgctcccgcctgcacaacaagccttccatctccccgacgctgctgctctgcaacatgtaccagcggccggacatgatcaccccgggcgtggacgcgcagggcaaccccatcgacccggagcggatccaggaggacttcgaggacttctacgaggacatcttcgtggagctgagcaagcacggcgagatcgagagcctccacgtctgcgacaacctcgcggaccacatgatcgggaacgtgtacgtggagttccgcgaggaggagcaggcggcccgcgccctgcaggcgctgcagggccgctactactcgggccgacccatcatcgccgagttctcgccggtgacggacttccgggaggccacctgccgccagttcgaggagcacagctgcaaccgcggcggatactgcaactttatgcacgtcaagcaggtcggccgggacctgcggcggaagctgtttggccacctgcatcgctccctccggagccacagccgaggcagccgcagcccgagcccataccgccgccgcggtagcttgtccaggtccagggaccgcgacgattaccacgactactactaccactactaccgtagtggcagtggcagccgcaggagcagcgagagacaccgcagccacgacagcgacgggagccgccgtcgacgcgggcggtcgaggagccggagccggagcccggtgagggaaggcagcgaggagcggagggcaaagattgagcagtggaaccgcgagcgggaggcagctcaggtgtaagcaagttccccttccctagttgccatgttggttgctgcagtgttattggccttgctagttgccatgttgctgttgctgaagcctgttatcatgtattgtggtgtggttcaggcagggtaaggccataaattgagcctgaaattggactgtg

SEQ ID NO: 96788 - protein, 287 aa, Zea mays
  misc_feature: Ceres CLONE 100955348
  misc_feature (13)..(39): Pfam Name: zf-CCCH Pfam Description: Zinc finger C-x8-C-x5-C-x3-H type (and similar)
  misc_feature (149)..(174): Pfam Name: zf-CCCH Pfam Description: Zinc finger C-x8-C-x5-C-x3-H type (and similar)
MAEHLASIFGTEKDRVNCPFYFKIGACRHGDRCSRLHNKPSISPTLLLCNMYQRPDMITPGVDAQGNPIDPERIQEDFEDFYEDIFVELSKHGEIESLHVCDNLADHMIGNVYVEFREEEQAARALQALQGRYYSGRPIIAEFSPVTDFREATCRQFEEHSCNRGGYCNFMHVKQVGRDLRRKLFGHLHRSLRSHSRGSRSPSPYRRRGSLSRSRDRDDYHDYYYHYYRSGSGSRRSSERHRSHDSDGSRRRRGRSRSRSRSPVREGSEERRAKIEQWNREREAAQV

SEQ ID NO: 96789 - DNA, 939 bp, Zea mays
  misc_feature: Ceres CLONE 100955629
  misc_feature: Encodes the peptide sequence at SEQ ID NO. 96790
tgctctactccccagtccccagaccccagtcccccactcggacctggggggcatcgcaccgaggacgacctcacgctggggcgggccttggtatattccttctcctccctgctcggtttagcacgcccgcttccagcacgcatcctcccctcctcccgtctcaagggatagcagggtgcagcggctcgaagctggaggaagcggacgggttcgccatggggtccgagggatcctcgggtccagttgtcgttcccagaaactttaggctgctagaagaactagaacgtggtgagaagggcattggtgatggaactgtgagctatgggatggacgatgctgatgacatatttatgcggtcctggacaggaactatcattggtcctcccaacactgttcacgagggacgaatctatcagttaaagctgttttgtgatacagattatccagataaaccaccgactgtccgattccagactcggatcaatatgacatgtgtgaaccaagaaactggattggttgaaccaagtctatttcctatgcttggaaagtgggaaagggaacatacgatggaggacattctgaccagcttaaaaagggagatgtcaactccacagaatcgcaggctgtaccaacctcatgaaggcaatgaagaccaaagagtagagcagaaaggggtgtctcttagatgtgtcatcatgtaatctatgtgcgttgcaatgtacagcattattgaattgagcagcgagatgccgaggtgagagaccctctcaggaaatcatgtggttcgccttaatgttaatggtgccaccatcgcaataaaagcgtcgatgattgttaaagtgcctgcacaccatgtaacgtgtaacccagttcgttcagattctgtgaaagacaacgagttcagtgtctgtttgttaagggctggctctaggcctggtt

SEQ ID NO: 96790 - protein, 161 aa, Zea mays
  misc_feature: Ceres CLONE 100955629
  misc_feature (17)..(159): Pfam Name: UQ_con Pfam Description: Ubiquitin-conjugating enzyme
  misc_feature: SWISSPROT Homolog: EC 6.3.2.19 Ubiquitin--protein ligase
MGSEGSSGPVVVPRNFRLLEELERGEKGIGDGTVSYGMDDADDIFMRSWTGTIIGPPNTVHEGRIYQLKLFCDTDYPDKPPTVRFQTRINMTCVNQETGLVEPSLFPMLGKWEREHTMEDILTSLKREMSTPQNRRLYQPHEGNEDQRVEQKGVSLRCVIM

SEQ ID NO: 96791 - DNA, 1328 bp, Zea mays
  misc_feature: Ceres CLONE 100955800
  misc_feature: Encodes the peptide sequence at SEQ ID NO. 96792
cagatgatgaagctggtgctctccctgcagatcccccaatcaccggatgagtgagccagcaccggcagctgcaactgtgagtctgtgaccagcatcaccacccactgcgcaagagtaagaagcaacagatgagatcaaccagcagctatactctcgactgtgcaaatgcttgatccttaaccccctgtctgctacttgtgtgatcatcatttgcttctcagctcattatgctgttggatcttatgcaggctaaagaatccaggctccaactcccacaattgcgagaaccaaagctaagctagctgctataactccacccaagctaagctgatccatggacatgccgccgaaccccgacagcccctcgtcaggagggagcaacagcatcggccggccgagtggcggcggcgcatcgccgtccgtcggttctacgatgccgcagtcgtcgccgagccggtacgaggcgcagaagcggcgcgactggaacacgttcggccagtacctgcggaaccaccggccgccactgagcctggcgcagtgcagcggggctcacgtcctcgagttcctccgctacctggaccagttcggcaagaccaaggtgcacggcccggcgtgccccttcttcggccacccgaacccgccggcgccgtgcccctgcccgctccgccaggcctggggcagcctcgacgccctcgtgggccgcctccgcgccgcctacgaggagaacggaggccgcccagagtccaatcccttcgccgcgcgcgccgtacgcctctacctctgcgaggtccgcgagcaccaggcccgcgcccgcggcgtcagctacgagaagaagaagcgcaggaagccgcagcagctgccgggcccgggcgacagcagcggccttcacggccacgcgcaccagccgccgcctccaccgcccgcgggcgccgcctgctgagctagctgatcgatccaccgctctttcgtgcgctctcccattcggccggtatgatgccagccagattgagcttgagcatgctcatatattttatgtatcattccgtgcgcgtatgcatgcatgtgcatggcgcagtgtagccatgcagctccatgctgctgatccgtctactctacctacctgctgctgagtgtaccgcattgcttgtctttatctgtgtttcgattcgatttagcattggtgttgtcgaatctatttgcttgtaggagtgagcaagtgtttgctgtactgtcaactgagtatatatgtccctttgagatctactagctagggactgggagatacatatatggtgatctctcttgctgtttctgttcgtggaaaattt

SEQ ID NO: 96792 - protein, 201 aa, Zea mays; identical to SEQ ID NO: 96764
  misc_feature: Ceres CLONE 100955800
  misc_feature (23)..(155): Pfam Name: DUF640 Pfam Description: Protein of unknown function (DUF640)

SEQ ID NO: 96793 - DNA, 1108 bp, Zea mays
  misc_feature: Ceres CLONE 100956536
  misc_feature: Encodes the peptide sequence at SEQ ID NO. 96794
gatcgatctcactctcagctggtcgctcactcttgcagctccacccttcactcagtcttaggctcttagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgaggctgctgctcctgctgatcccgaggagcttcccgcggccgagcagcaggcagccgccgagcccgaggccgctgctcctgctggtgccgaggctgaggctgctgctcctgctggtcccgaggagactcccgcggccgagcaggaggcagccgccgaggaggaggctgctgctgctcctcctgctggtgccgaggagcccgccgcggccgagccggtcgccgaggcagaggctgctgctcccgaggagctcgccgcggacgagccggaggctcctgctcctgctggtccccaggagccggccgccgaggcggaggaggttgctgctcctgaggagcccgagaaggccagcgagtgaggccgtgcgcacgcagcggcggcggccagggcccaggggatcggcgtgcgcgcgtggcggggtagtcgctcgcgcgcgtacatggcagtatgacacgggattttgctgttcagtacgctacggttattactggcgtctctctctgtgtgtgtgtgtgtctcgtacgtagcccggtacgtagctagcagtgactgtcgcgtggacgtgtccggtgcgggctgcgagtgacgtgggctaaataaagtgtgcgtcgggtggtaatggtggtggggcccggtgtcagtggcgcggtgccccatgcctgccgctgctgcagcttgttgtgtcttgtgttggttggttcctgttctttctgtctatctattctcatgcatggcagtttgggtatggtatgggtcgtcttctttggttacgttccctgcattctgtttgtgtcattgtgtgatgatacgatcttctttatataataatagagccagtcgttcatcagc

SEQ ID NO: 96794 - protein, 161 aa, Zea mays
  misc_feature: Ceres CLONE 100956536
MATAEVQTPTVVAAEEAPVVETPPPAVVPEESAPAEAEAEAEAEAAAPADPEELPAAEQQAAAEPEAAAPAGAEAEAAAPAGPEETPAAEQEAAAEEEAAAAPPAGAEEPAAAEPVAEAEAAAPEELAADEPEAPAPAGPQEPAAEAEEVAAPEEPEKASE

SEQ ID NO: 96795 - DNA, 1462 bp, Zea mays
  misc_feature: Ceres CLONE 100958047
  misc_feature: Encodes the peptide sequence at SEQ ID NO. 96796
ccggtgcgccatcgctctcgtcctcgccgatcgatccaagagactgggaccttcaaagagcaataggactcatggaggttggagacgcaagaaacggttctgcagcagcggcactgacaaagggaggtgcggatgatgccgcccgcaaaccgctccctccttgctgcgtcaaggccaaggcgcgggtgcctgaaaccgaggccaactgccatgatactgtggtttcagggtggttcacggaacccagatcgcgttttggagaggcccattcattgaaagtggagaagatcttgtttcaagggaaatcgccttaccaagaaattttagtttttgagtcttcaacctatggaaatgttcttgtgcttgatggtatagttcagttgactgacaaggatgaatgcgcataccaggaaatggttactcaccttccactgtgctcaattcctgcaccgaagaatgttttggttgttggaggtggtgatggtggtgtactgcgcgaaatagccagacatgattcagtggaaactattgatatatgtgagattgatctactagttattgatgtttccaaagaattctttccaaacctatccattggattcaaagatcctcgtgtccgacttcatgttggtgatgctgttgatttcctgaggaattctcccgaaggaaaatatgatgctattattgtagattcatcagatccaattgggccagcacaggcactcgtggagaaaccgtttattcagacaattgctagagctttgaagcctggtggtgttctttgtaatcttgctgagagcatgtggctgcacacacatctaatccaggatatgcttgctatctgtcgacagacattcaaaggtgctgtgcactatgcctggacaagtgttccaacatatcccagtggtgtcattggatttttgctatgtgcaaaagaaggtcgtgcagtgaacttcttgactcctgcgaatccaattgagaaaatagaaggagcagcaaaagctggaagggaactcagattttacaattccgagatccatagggctgcttttgttctgccaacatttgtaagaagagaactggaagcatataccactcctattagttttgctgaaaacgagaaaccgaaagaatcagtgtcagaaccgcagaagataaagatattgtcaaacaacgccattcttacagcttcctagccctgagccgtactcaatcttgctcggtatagttgtattctcacagaataaatcagtcactggcttttgctgacaccgcacgagcagctttagtatagaatgatgatcgattgaataagagggtggatattgaactgatgtaatgcctctgccgaaacaatatgtctccctatcttgttaggcgtgttgtgtgttgtgcacgatttcagctgtagcttgtaaattgtacgacccgttgatgtaatgtataccctgcgtttgtgctg

SEQ ID NO: 96796 - protein, 374 aa, Zea mays
  misc_feature: Ceres CLONE 100958047
  misc_feature (53)..(297): Pfam Name: Spermine_synth Pfam Description: Spermine/spermidine synthase
  misc_feature: SWISSPROT Homolog: EC 2.5.1.16 Spermidine synthase
MEVGDARNGSAAAALTKGGADDAARKPLPPCCVKAKARVPETEANCHDTVVSGWFTEPRSRFGEAHSLKVEKILFQGKSPYQEILVFESSTYGNVLVLDGIVQLTDKDECAYQEMVTHLPLCSIPAPKNVLVVGGGDGGVLREIARHDSVETIDICEIDLLVIDVSKEFFPNLSIGFKDPRVRLHVGDAVDFLRNSPEGKYDAIIVDSSDPIGPAQALVEKPFIQTIARALKPGGVLCNLAESMWLHTHLIQDMLAICRQTFKGAVHYAWTSVPTYPSGVIGFLLCAKEGRAVNFLTPANPIEKIEGAAKAGRELRFYNSEIHRAAFVLPTFVRRELEAYTTPISFAENEKPKESVSEPQKIKILSNNAILTAS

SEQ ID NO: 96797 - DNA, 859 bp, Zea mays
  misc_feature: Ceres CLONE 100959093
  misc_feature: Encodes the peptide sequence at SEQ ID NO. 96798
ccccctctgccccactcccaaaatcttgacgcctgacgtccccacaagtgatcggcatgagtaacacagctgaggaaaacactggcggcggcggcggcggcagcaccccgacgcgcgttgtggtagtcgagcgcgtggtgacggtggagtacctggagccgtccatgtcgcgggagctgctgggcaagttcccggacccatccgccttcgacttcgactactcgcagagcggaatctggtcgccgctcaacaaggtcccgcgcggcggcgcgtgcgagcccgagacggccgacgccaccaactcctcgaccgacttcctcatcgccaacccgaagcgcagggcgagggccggcggccggcccaaggactcggccggcggcgggaggtccaggtggaggcgcagacggctgcggcgagacgggtccttcctggacctccacgagactggcagggccaggctcgacttctcgccgccggcaccttcccccgcgaaggaggggtggaggtgggtgctcaaggcggccatcaggaagttcaaggcgcggcagcggcggtcccggcaggctcccctgctccagatggtcctccccatgctgtgatgatcgatcgatcgatctcgcgcgctcacacgaattgtgcttgccttttgtttccacttgttccatcacagttctattcattgcatccggacgctggtccatgcctcgcctgtattatagttgagttcagatttgcttcaagttgtattgtaaccgtgtaatgcagctaatgctcttgctggagaaatatattggtgtacatcttttcattcgatttcaatcccttcaggctccaagtgagaggaggatattcatggaac

SEQ ID NO: 96798 - protein, 180 aa, Zea mays
  misc_feature: Ceres CLONE 100959093
MSNTAEENTGGGGGGSTPTRVVVVERVVTVEYLEPSMSRELLGKFPDPSAFDFDYSQSGIWSPLNKVPRGGACEPETADATNSSTDFLIANPKRRARAGGRPKDSAGGGRSRWRRRRLRRDGSFLDLHETGRARLDFSPPAPSPAKEGWRWVLKAAIRKFKARQRRSRQAPLLQMVLPML

SEQ ID NO: 96799 - DNA, 1231 bp, Zea mays
  misc_feature: Ceres CLONE 100959167
  misc_feature: Encodes the peptide sequence at SEQ ID NO. 96800
aagcagcacgggcaacacgccgagcaaaacagcgaaatcctcaaatccccaccccggctggtgacggcgccgcccccgctgctgcctgcggtcctgcttctgctaatagtaataggtattcagattcgagcagagcactcccgtgctgcaggcaagggaggacgcaccaccatggattgggatgctccggcattgacgagcttcgtcgccgacttgtccttccgccacctctgctgctacggggccggaatcgcagggaacgccttcgccttcgtgctcttcgtctccccgctccccacattcaagaggatcgtccgcaacggatccacggagcagttctcgtgcacgccgtacatctactcgctgctcaactgcctcatctgcatgtggtacggcctccccttcgtctcctacggcgtcgtcctcgtcgccaccgtcaactccatcggcgccgtgttccagctcgcctacaccgccgtgttcatcgccttcgccgacgccaagcagaggctcaaggtctctgctctcctggccgctgtcttcctggtgttcggactgattgtgtttgttagtctggctttgttggatcacaaagcccggcaggtgttcgtcggatatctcagcgtcgcgtccctcgtatgcatgttcgcgtcccccatgtcaatcgtcaatctggtcatccggacgaagagcgtggaatacatgcccttctacttgtcattatccatgtttttgatgagtgcatccttcgtcatatacggagtgctgcttggtgatggcttcatatatattccaaatggcattggaaccatattgggtatcgtacagttgctgctgtatgcctacatcagaaagggatcaagcgaggaagccaagctgcccttactaatcacacatacatgagcatgccaaaagggaaaaaaaacaaggttcgataacctgcccatttgttctcgctctctcatttcttttttttaactttataaccatttggtaacgttgtagcagctgcccattaaagcaacttcatctttacacgtcatagataagtttttcaattaaatactgcttacaaaaagtctgtatatatttaatgttcggataacctgcaagcaatcacatgttcattttgaaaatgtttgcttcaatagactttgccaaagacatactagaagcaacctcgtttttacacatatgggtggtcaataaagacgcaggtagcttttttttt

SEQ ID NO: 96800 - protein, 243 aa, Zea mays
  misc_feature: Ceres CLONE 100959167
  misc_feature (145)..(231): Pfam Name: MtN3_slv Pfam Description: MtN3/saliva family
  misc_feature (26)..(112): Pfam Name: MtN3_slv Pfam Description: MtN3/saliva family
MDWDAPALTSFVADLSFRHLCCYGAGIAGNAFAFVLFVSPLPTFKRIVRNGSTEQFSCTPYIYSLLNCLICMWYGLPFVSYGVVLVATVNSIGAVFQLAYTAVFIAFADAKQRLKVSALLAAVFLVFGLIVFVSLALLDHKARQVFVGYLSVASLVCMFASPMSIVNLVIRTKSVEYMPFYLSLSMFLMSASFVIYGVLLGDGFIYIPNGIGTILGIVQLLLYAYIRKGSSEEAKLPLLITHT

SEQ ID NO: 96801 - DNA, 980 bp, Zea mays
  misc_feature: Ceres CLONE 100959609
  misc_feature: Encodes the peptide sequence at SEQ ID NO. 96802
ccgccgccttcgcctaaagaggcctcgccctcccccctccggcgaaaaccgattcccttccccgattccctccggcgtttcctgggtccctctccatcctcaccgctttcttcctctgcaggtcccttagtgcaagcaaggacaccgctcctctagcgagctctgttctgaagcggcaagaaagatgattaatcttttcaaaataaagggtcaaaagaaagaagaggcagcaagtgctgctggaaaggcccctgttaagaaacagtctgctggggagctccgtcttcataaagatattagtgagctcaacctgccgaagaccacatcaatttcttttcccaatggcaaggatgatctgatgaattttgagaccaccatccgacctgatgaaggatattacatgggcggcactttcgttttcacctttcaagtgtccccatcttatcctcatgatcctccgaaggtcaaatgcaagaccaaggtgtaccatccaaatattgatctggaaggcaatgtctgtctgaacattctgcgcgaagattggaagcctgttctcaacatcaacactgttatttatggcctgaatcttctttttacgcaaccaaacgacgaggatcctctgaaccacgaagctgcagttgtccttcgcgacaatccaaagatgtttgaggcaaatgtgagaagagccatggctggaggctacgtcggccaacactatttccaaagatgtgcttgacttgatgtggtggtggcttgaaaacgatcaacagagcccctccccctgtatcagcaccagcgcgcccagctttgtgtgcggaaagtgcttctggaagcaaaatccaaaccgttcatggtgtgacatctgtttgcccgcctttgtgatgtgtggtatagtggtggtgcataatgacagggaaatgcttctctaactgtatcattcattccataaatcctaaacgaggaatgggaagtggattgtt

SEQ ID NO: 96802 - protein, 183 aa, Zea mays
  misc_feature: Ceres CLONE 100959609
  misc_feature (33)..(169): Pfam Name: UQ_con Pfam Description: Ubiquitin-conjugating enzyme
  misc_feature: SWISSPROT Homolog: EC 6.3.2.19 Ubiquitin--protein ligase
MINLFKIKGQKKEEAASAAGKAPVKKQSAGELRLHKDISELNLPKTTSISFPNGKDDLMNFETTIRPDEGYYMGGTFVFTFQVSPSYPHDPPKVKCKTKVYHPNIDLEGNVCLNILREDWKPVLNINTVIYGLNLLFTQPNDEDPLNHEAAVVLRDNPKMFEANVRRAMAGGYVGQHYFQRCA

SEQ ID NO: 96803 - DNA, 1396 bp, Zea mays
  misc_feature: Ceres CLONE 100962591
  misc_feature: Encodes the peptide sequence at SEQ ID NO. 96804
cacacacactctacacgcgagcgagaccacgcgccggaccgccgcaagccggccgccgccgccgcgacctggagcttgcgagctagctctggcctcgctgcctgcgccgactgagatggacccgcgctttccgctgccggccgcggcggcgccgtccacgggcggcggcggcggcgccagagggcaccaccggcgggcccactcggagacgttcctcagcttccacgacgcggacctgctcctcgacccggacggcgacttcttctccgacctcgacttcccctccctctccgacgactctccggccgcctccgaccccaccccgccgccgcatccgcagcagcagccgccgcaggcttccccggccccacgtccgcccggcgggacccacacgcggagcctctccctcgacgccgccttcttcgagggcctcgcgtttcagggacccagtgggagcgccgggggtggaggtgggcccggccacaagaggagcggctcgatggatggggacacctcgccgttcgagggcgagtcggcgctctccagcggcctgccggactacgccaagaaggccatgcccgccgagaggatcgccgagctcgcgctcatcgaccccaagcgcgcaaagaggattctggcgaacaggcagtcggcagcgaggtcaaaggagaggaagatcatgtacactagtgaactggagaagaaggtccagactctgcaaacggaggccactacgctgtcagcacagctgaccctgctccagagggatacaactggtttaactgccgaaaacagagagctcaagcttcggttgcagtccatggaagagcaagctaaactgcgggacgctttgaatgaagccctgcgagaagaagtccagcgacttaagatagccgcaggacaagtcgggaacatgaatgggaaccccttcaatggtggactccagcagcagattccatcctatttcgtgcagcagcagcagcagcagcagacaccgtactttggtggccaccaggctcagcttcacaatcaaaatcaaaaccatcgtcaccagatctcgtcaaatgttgggcagacgctcagtggtcagtccctaaacgactccatggatttcatgtgaggagtacaatatcagggccagtattacatcgtataccgactgcagttcagcactgtaaaaaagatagctaatgtacaatgtatgcatgtgcctcattggtagtgtgtagttagctcttctttgtatcattattctgaaaatggctcgtgtatgtcaaaatgatgtctcttttcttctttgctggtttctggagtaatgtgttagactgactagctacctttaacaatttatgtaaatctttagctttttttttaatggtggaaggtttttatacat

SEQ ID NO: 96804 - protein, 334 aa, Zea mays
  misc_feature: Ceres CLONE 100962591
  misc_feature (164)..(218): Pfam Name: bZIP_2 Pfam Description: Basic region leucine zipper
MDPRFPLPAAAAPSTGGGGGARGHHRRAHSETFLSFHDADLLLDPDGDFFSDLDFPSLSDDSPAASDPTPPPHPQQQPPQASPAPRPPGGTHTRSLSLDAAFFEGLAFQGPSGSAGGGGGPGHKRSGSMDGDTSPFEGESALSSGLPDYAKKAMPAERIAELALIDPKRAKRILANRQSAARSKERKIMYTSELEKKVQTLQTEATTLSAQLTLLQRDTTGLTAENRELKLRLQSMEEQAKLRDALNEALREEVQRLKIAAGQVGNMNGNPFNGGLQQQIPSYFVQQQQQQQTPYFGGHQAQLHNQNQNHRHQISSNVGQTLSGQSLNDSMDFM

SEQ ID NO: 96805 - DNA, 862 bp, Zea mays
  misc_feature: Ceres CLONE 100966116
  misc_feature: Encodes the peptide sequence at SEQ ID NO. 96806
cgactttgaccagcgttgcaattgcagcctactccgccgccctatcgttctcgcctctccctactaacccacctaccggaagagacgagggtggccgccgccttctcccgctctgcctctcttcatgggccaggtcgagagccaggctacccgtccgtcggaggagccttctccacccgtcgtggagccgtcgccgccgtcttctgccccgcctccgtcctcccttgaggcgcttgccgcagaggccatgtcatttgacgaggatgacactgaggagtcaatcgaaatgaaggtacagaaagctctggactgtccatgtgtcgctgatttgaaaaatggtccttgtggaggtcaattcgtcgatgcattttcctgcttcctcaggagcacagaagaagagaagggatcggattgcgtgaaacccttcatcacattgcaggattgcattaaagcaaatccagaggcattctctaaggagattttggaggaagaggagaatgagaaggaggcagataagtccaacctgaaagttagagctccatcatggtccagagaatccaaccctaaggtttgagattgcatgatattaaatgataaccgtatagaagttctccagtagtggagtagcggattgattttagagagagcaaagaggcatcataaattgattggcagaaatacccatatttagtttggtagaaatgcctcacgatatttttttgagaatgtacacgtcaattcaagtatcaacctagaaacaatgaacatgtaattcgattctttaaggaaaatgtttagtgattttggtgtttgatggtgaaaataacattttggactaatatatttgctagtgtttatgttt

SEQ ID NO: 96806 - protein, 149 aa, Zea mays
  misc_feature: Ceres CLONE 100966116
  misc_feature (67)..(110): Pfam Name: CHCH Pfam Description: CHCH domain
MGQVESQATRPSEEPSPPVVEPSPPSSAPPPSSLEALAAEAMSFDEDDTEESIEMKVQKALDCPCVADLKNGPCGGQFVDAFSCFLRSTEEEKGSDCVKPFITLQDCIKANPEAFSKEILEEEENEKEADKSNLKVRAPSWSRESNPKV

SEQ ID NO: 96807 - DNA, 1397 bp, Zea mays
  misc_feature: Ceres CLONE 100969732
  misc_feature: Encodes the peptide sequence at SEQ ID NO. 96808
cggcgctcctcccgtcttcttcttcttcttcctgtactatatatatatagcttcccctcgcaaattgtcactgacgttcattcggcttgcttgattgttccaggtattcgcagtcgaccgtgtcctcggagcacgtaagttacgaatcttcgcttcttcttgtgatagtgtttcgagttgcctcatgtttaccttgagtcgtctgccggctcgccacatggtcaaggcgcatcgccgtcgatgcccgctcgattccaccgtcagccagatttttctggctcgatgtacctgcgacgtagtgtggagatgagacgcgcaggtgacgccggatgctagggaaccggaactagatccggtccctgctactgtggtggctgcgctggtttctgaattctcatattgggatttgaatgaatccttgaaacatttataacatgccttgaccgcttgtttacttaggtctctagttgaggagggcattgttaagatttgctctggtccatgagcgtgtatgtttacttgttgtggtctgtagtacgtattcaccaagtaatttttggtgttttcaccgtagatactggtctctaattctctatgctcttctgtttggttgtccgttaagcctgttggtattttttctgatgcttcagtatgtcctgctgtctgacaccttcmacataactcttgttatcatacattagtgcttgagcttttctttggattctaacagacaatagattcaaggtactctggtaatttgatttttaggttgatttgctttagttccttggttcagttgctttaccattttattacctgacatcactgtcatgtggctaaagagttaacttaactgatacgatgatttctgatggcttgagcaggatgaaggttgttgctgcctacctgcttgctgtcctcgctgggaatgccagcccctccgctgaggatttgactggcattctggagtcagttggctgtgaagttgacaatgaaaggatggaactgctgctgtcccaactgagcggtaaggacatcaccgagctcattgccgcgggcagagagaagtttgcttcagtcccatgtggcggcggcggtgtggctgttgcggcaggtgcacctgctgctggcggagctgctcctgcagctgaggcaaagaaagaagagaaggtggaagagaaggaagaaagcgatgatgatatgggcttcagcctcttcgactaggttgcacagtcatcacagtattgtttcgggcagtgaaatcaaagggaaaccagagtcatgtttagattttacccttattttatgttggaaagtactgcaaagactgctaattgtctctgtatttggtaattcagctgtagattgctatgatggttgggatttactcgtgaacc

SEQ ID NO: 96808 - protein, 120 aa, Zea mays
  misc_feature: Ceres CLONE 100969732
  misc_feature (25)..(119): Pfam Name: Ribosomal_60s Pfam Description: 60s Acidic ribosomal protein
MISDGLSRMKVVAAYLLAVLAGNASPSAEDLTGILESVGCEVDNERMELLLSQLSGKDITELIAAGREKFASVPCGGGGVAVAAGAPAAGGAAPAAEAKKEEKVEEKEESDDDMGFSLFD

SEQ ID NO: 96809 - DNA, 705 bp, Zea mays
  misc_feature: Ceres CLONE 101296330
  misc_feature: Encodes the peptide sequence at SEQ ID NO. 96810
ttcatccgccttcgcctccaaccgcgtgcgctccacgcctcctccaggaaagcgagagcttctgcataagaacaacaaatcaaaagcttgatcagctcggtgcctacaaaacctcaacaaccaagtttcatgtctgatctcgacgtccagcttccatctgcctttgatccgttttttgtggcaaatgctgaggactctggtgctggtcctggaacgaaggattatgtgcatgtgcgcatccagcagcgcaacggcagaaagagtctgactacagtccagggtctgaagaaagagttcagctataacaagatcctcaaggatctgaagaaggaattctgctgcaatggtactgtagttcaggacccagagctaggccaggtcattcagctccaaggtgaccagcgcaagaatgttgctactttcctagttcaggctgggattgcgaagaaagagaacatcaagattcacgggttctaagggacctgtaaatgcttgtgccctatattgtgtgcctccacatataaaaaaaaaaaaaagcatcgacagttactagtcattgcttacttatataagaacataagtagtatttgctattgtcaagtgtgccttgcttgatgcaagttgtgttttcgtatcattattattatgcacggccatacgtacgtgtatgccttgtatgggttattgccaacttaataaaagcac

SEQ ID NO: 96810 - protein, 115 aa, Zea mays
  misc_feature: Ceres CLONE 101296330
  misc_feature (27)..(108): Pfam Name: SUI1 Pfam Description: Translation initiation factor SUI1
MSDLDVQLPSAFDPFFVANAEDSGAGPGTKDYVHVRIQQRNGRKSLTTVQGLKKEFSYNKILKDLKKEFCCNGTVVQDPELGQVIQLQGDQRKNVATFLVQAGIAKKENIKIHGF

SEQ ID NO: 96811 - DNA, 687 bp, Zea mays
  misc_feature: Ceres CLONE 101296416
  misc_feature: Encodes the peptide sequence at SEQ ID NO. 96812
attcgagtcgaaaaggacatcatttgctagatggcgcgtaccaagcagaccgctcgcaagtccactggaggaaaggctcctaggaagcaactcgctacaaaggcagtttttttttttgcacccacaactggaggagtgaagaagcctcaccgttaccgcccagggactgttgctcttcgtgagatccgcaagtaccagaagagcactgagttgctgattaggaagctgccgttccagaggcttgtgagggagattgctcaggatttcaagacggatctgcgcttccagagccatgccgtgcttgctctgcaggaggcagcagaggcctacctggttggtctcttcgaagataccaatctgtgcgcgatccatgccaagcgcgtgaccatcatgcccaaggacattcagctggcaagaaggatccgtggcgagagggcgtgagtctgtcgacgggaggaagaactctgcgctcgttttgtgtgttcgcctctctcaccctgtaagttttgtgaaaagataatctagtaaactgtacttggcctgtttgactgtagccgcagtagcgtatgcgcatactattggctgttgtcgtgtctggagtcttttatccatccattctactacttaataatcgggttgctgaacgtgtatccagacttaactgtgtgtttggctgtctgaacctgg

SEQ ID NO: 96812 - protein, 136 aa, Zea mays
  misc_feature: Ceres CLONE 101296416
  misc_feature (58)..(132): Pfam Name: Histone Pfam Description: Core histone H2A/H2B/H3/H4
MARTKQTARKSTGGKAPRKQLATKAVFFFAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 96813 - DNA, 678 bp, Zea mays
  misc_feature: Ceres CLONE 101298038
  misc_feature: Encodes the peptide sequence at SEQ ID NO. 96814
  misc_feature (496)..(496): n is a, c, t, g, unknown, or other
  misc_feature (506)..(506): n is a, c, t, g, unknown, or other
gaggtcacttgctctccctccaacaagctaattaaggccggtcatccctcttctagctcgtttcattatccatggcggaggagaagcaccaccaccaccacctgttccaccacaagaaggacgaggagcagctcgccgccggcgggtacggcgagtccgccgagtacacttttttttttttgacggaggtggtgtccacgggcgagaacgagtacgacgagtacaagaaggaggagaaggagcacaagcacaagcagcacctcggcgaggccggcgccatcgccgccggcgccttcgcactctacgagaagcacgaggcgaagaaggacccggagcacgcgcaccgccacaagatcgaggaggaggtcgcggcggcggcggccgtcggctccggcggcttcgccttccacgagcaccacgagaagaagaaggaccacaaggaggccgaggaggccggcggcgagaagaagcaccacttcttcggctgattgatcanaaaaaaaaanacgtccctccccgtgtgctacgcgtgcgtgtgagagtgatatcgagcgcccgccgtgttgtgcgcgcgtacgtatgtatgcgctcgtgtgatgcacgaataagcgtggctacgtaatctatagtatgtatacgtgtgtgtatgcatgtgcttgtgtatgatcgtggtacgag

SEQ ID NO: 96814 - protein, 138 aa, Zea mays
  misc_feature: Ceres CLONE 101298038
  misc_feature (49)..(128): Pfam Name: ABA_WDS Pfam Description: ABA/WDS induced protein
MAEEKHHHHHLFHHKKDEEQLAAGGYGESAEYTFFFLTEVVSTGENEYDEYKKEEKEHKHKQHLGEAGAIAAGAFALYEKHEAKKDPEHAHRHKIEEEVAAAAAVGSGGFAFHEHHEKKKDHKEAEEAGGEKKHHFFG

SEQ ID NO: 96815 - DNA, 711 bp, Zea mays
  misc_feature: Ceres CLONE 101298092
  misc_feature: Encodes the peptide sequence at SEQ ID NO. 96816
  misc_feature (528)..(528): n is a, c, t, g, unknown, or other
cccacgagatccaattgtcacttgctctccctccaacaagctaattaaggccggtcatccctcttctagctcgtttcattatccatggcggaggagaagcaccaccaccaccacctgttccaccacaagaaggacgaggagcagctcgccgccggcgggtacggcgagtccgccgttttttttttggccacggtgacggaggtggtgtccacgggcgagaacgagtacgacgagtacaagaaggaggagaaggagcacaagcacaagcagcacctcggcgaggccggcgccatcgccgccggcgccttcgcactctacgagaagcacgaggcgaagaaggacccggagcacgcgcaccgccacaagatcgaggaggaggtcgcggcggcggcggccgtcggctccggcggcttcgccttccacgagcaccacgagaagaagaaggaccacaaggaggccgaggaggccggcggcgagaagaagcaccacttcttcggctgattgatcctcccgtatcgtcgtccctanaaaaaaaaaaagcgtgcgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaac

SEQ ID NO: 96816 - protein, 138 aa, Zea mays
  misc_feature: Ceres CLONE 101298092
  misc_feature (49)..(128): Pfam Name: ABA_WDS Pfam Description: ABA/WDS induced protein
MAEEKHHHHHLFHHKKDEEQLAAGGYGESAVFFLATVTEVVSTGENEYDEYKKEEKEHKHKQHLGEAGAIAAGAFALYEKHEAKKDPEHAHRHKIEEEVAAAAAVGSGGFAFHEHHEKKKDHKEAEEAGGEKKHHFFG

SEQ ID NO: 96817 - DNA, 699 bp, Zea mays
  misc_feature: Ceres CLONE 101298653
  misc_feature: Encodes the peptide sequence at SEQ ID NO. 96818
gatccaattgtcacttgctctccctccaacaagctaattaaggccggtcatccctcttctagctcgtttcattatccatggcggaggagaagcaccaccaccaccacctgttccaccacaagaaggacgaggagcagctcgccgccggcgggtacggcgagtccgccgattttttttttttcacggtgacggaggtggtgtccacgggcgagaacgagtacgacgagtacaagaaggaggagaaggagcacaagcacaagcagcacctcggcgaggccggcgccatcgccgccggcgccttcgcactctacgagaagcacgaggcgaagaaggacccggagcacgcgcaccgccacaagatcgaggaggaggtcgcggcggcggcggccgtcggctccggcggcttcgccttccacgagcaccacgagaagaagaaggaccacaaggaggccgaggaggccggcggcgagaagaagcaccacttcttcggctgattgatcctcccgtatcgtaaaaaaaaaccgtgtgctacgcgtgcgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgygcttgtgtatgatcgtggtacgaggaccgaaaaatgtatg

SEQ ID NO: 96818 - protein, 138 aa, Zea mays
  misc_feature: Ceres CLONE 101298653
  misc_feature (49)..(128): Pfam Name: ABA_WDS Pfam Description: ABA/WDS induced protein
MAEEKHHHHHLFHHKKDEEQLAAGGYGESADFFFFTVTEVVSTGENEYDEYKKEEKEHKHKQHLGEAGAIAAGAFALYEKHEAKKDPEHAHRHKIEEEVAAAAAVGSGGFAFHEHHEKKKDHKEAEEAGGEKKHHFFG

SEQ ID NO: 96819 - DNA, 705 bp, Zea mays
  misc_feature: Ceres CLONE 101309905
  misc_feature: Encodes the peptide sequence at SEQ ID NO. 96820
taattaaggccggtcatccctcttctagctcgtttcattatccatggcggaggagaagcaccaccaccaccacctgttccaccacaagaaggacgaggagcagctcgccgccggcgggtacggcgagtccgccgagtacacggaggccacggtgacggaggtggtgtccacgggcgagaacgagtacgacgagtacaagaaggaggagaaggagcacaagcacaagcagcacctcggcgaggccggcgccatcgccgccggcgccttcgcactctacgagaagcacgaggcgaagaaggacccggagcacgcgcaccgccacaagatcgaggaggaggtcgcggcggcggcggccgtcggctccggcggcttcgccttccacgagcaccacgagaagaagaaggaccacaaggaggccgaggaggccggcggcgagaagaagcaccacttcttcggctagctgattgatcctcccatatcgatcgtcgtccctccccgtttgctacgcgtgcgtgtgagagtgatatcgagcgccggccggcctgcacgcccgccgtgttgtgcgtacgtacgtacgtatacatgtatgtatgtatatgcgcgcgtgtgatgcacgaataagcgtggctacgtaatctatcgtatgtatacgtgtgtgtatgcatgtgcttgtgtatgatcgtggtacgaggaccgaaaaaatgt

SEQ ID NO: 96820 - protein, 138 aa, Zea mays; identical to SEQ ID NO: 10635
  misc_feature: Ceres CLONE 101309905
  misc_feature (49)..(128): Pfam Name: ABA_WDS Pfam Description: ABA/WDS induced protein

SEQ ID NO: 96821 - DNA, 582 bp, Zea mays
  misc_feature: Ceres CLONE 101311215
  misc_feature: Encodes the peptide sequence at SEQ ID NO. 96822
ctctgaagagataacgagctgcgcttcttcgtcctcgatcaactagcttctctgatcagttccatatggagagagccgcgtcaagctgcgctagcctcctagcacaaaggaggtgctactccgtggccgcggtcgtggtgaagggatgcgggcggaaggccgtggagaaggtggccaagcgcatcatgggcaaggaggtgaacaccgccgctgcctccggggagaagacgccgtgggtgccggacccggtcaccggctactaccgcccggcgggtggcgccaaggaggtggacgcggcggagcttcgcgccaggctgctcaccaagaggatcgccaactaaatcaatctagcagcagagcagtgcggctgagattatttagcgccagttgatctcttgggcctagagcatgacggtgctgtaacttttgaggcataatatatatagatagatagatgggaagagctcgaacgtatctccgtttctagaaagaatggcgcaattcttgctttgctttttaacgagtcaatttgtcttgactttaccatattgtatacgaaaatgtactaatatttatggtata

SEQ ID NO: 96822 - protein, 91 aa, Zea mays
  misc_feature: Ceres CLONE 101311215
  misc_feature (1)..(86): Pfam Name: LEA_3 Pfam Description: Late embryogenesis abundant protein
MERAASSCASLLAQRRCYSVAAVVVKGCGRKAVEKVAKRIMGKEVNTAAASGEKTPWVPDPVTGYYRPAGGAKEVDAAELRARLLTKRIAN

SEQ ID NO: 96823 - DNA, 648 bp, Zea mays
  misc_feature: Ceres CLONE 101500247
  misc_feature: Encodes the peptide sequence at SEQ ID NO. 96824
cactgtaggggtaccttgagcctgttcaccgccgtcgcctgccgcctcacatccacagcatccatggccgacacagctcgcctcttcatgctggtggcggtggccacggcggcgctcgccggccgctcagacggcgcgtggtgcgtgtgccggtcggacctggcggacagcgcgctgcagaagacgctggactacgcgtgcggcggcggcgccgactgcaagcccatcctgcagagcggcgcctgcttcgccccggacaccgtcaaggcccactgctcctacgccgccaacagcttctaccagcgcaacggccagaacccgcaggcctgcgtcttctccggcaccgccgcgctcagcaacgtcgacccgagcaccaatggctgcacgtaccctgcgaccccaagtgctgctgcaacgacgagcagcagcagcggttcggccggcgtgtacagccctccagcgatgggtccgtcggccctcaacgacaacagcgctgccgccggcgtcgtcctcccgatggctggcgctgggcggctgctgatcctggcctgctgctcgctcgtcgctttttactacctcggcgcgtgatgaactgatgatcgtgtgaggacgagacgccgctccccgctgccgcttgctgttgttggg

SEQ ID NO: 96824 - protein, 174 aa, Zea mays
  misc_feature: Ceres CLONE 101500247
  misc_feature (25)..(109): Pfam Name: X8 Pfam Description: X8 domain
  misc_feature: SWISSPROT Homolog: EC 3.2.1.39 Glucan endo-1,3-beta-D-glucosidase
MADTARLFMLVAVATAALAGRSDGAWCVCRSDLADSALQKTLDYACGGGADCKPILQSGACFAPDTVKAHCSYAANSFYQRNGQNPQACVFSGTAALSNVDPSTNGCTYPATPSAAATTSSSSGSAGVYSPPAMGPSALNDNSAAAGVVLPMAGAGRLLILACCSLVAFYYLGA

SEQ ID NO: 96825 - DNA, 1184 bp, Zea mays
  misc_feature: Ceres CLONE 101653967
  misc_feature: Encodes the peptide sequence at SEQ ID NO. 96826
catgggtggactctaccagtaccagctgcccagctaccgcaccaacccctgtggcgtctccgctgccattccgccctactactgattcatgatatttgggaaatctcctctatccatctctctctatctatatatgtaataatgcagtaagacgacacacattatcatgtgtggtatgaccaataatatatgcatggtcataataaagttttggttttaatgaatctatcggccgcttgatgtcaaaaaaaaaaaaaaaaaaaaaaaaaaaaaaaaaaaaaaaaaaaaaaaaaacctcgagactagttctccctcgtgccgaattcggcccgaggagaccaactagcaccatagaaggcccaatagtgtcccaacaatggcagccaaaatattttgcttccttatgctccttggtctttctgcaagggctgctaccgcaaccattttcccacaaggctcacaagctcctatagcttccttttttcccccatacctttcaccaggggggtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctgctgcttatttacaacagcaacagctaccaccattcagccagctagctgatgtgagccctgttgccttcttgacacaacaacagttgttgccgttctacctgcacgctgcgcctaacgctggcaccctcttacaactgcaacaattgctgccattcaaccaacttgctttgacaaacccaacagcgttctaccaacaacccatcattggtggtgccctcttttagattgcttatgagttatagttcaataatgaagttttttggatgatgtttgtggcttcccagaaataagaaagtacatttctagattcttaaaaaaaaaaaaaaaaaa

SEQ ID NO: 96826 - protein, 233 aa, Zea mays
  misc_feature: Ceres CLONE 101653967
  misc_feature (1)..(233): Pfam Name: Zein Pfam Description: Zein seed storage protein
MAAKIFCFLMLLGLSARAATATIFPQGSQAPIASFFPPYLSPGGSSVCENPILQPYRIQQAIAAGILPLSPLFLQQPSALLQQLPLVHLLAQNIKAQQLQQLVLGNLAAYSQQQQFLPFNQLAALNSAAYLQQQLPFSQLAAAYPQQFLPFNQLAALNSAAYLQQQQLPPFSQLADVSPVAFLTQQQLLPFYLHAAPNAGTLLQLQQLLPFNQLALTNPTAFYQQPIIGGALF

SEQ ID NO: 96827 - DNA, 911 bp, Zea mays
  misc_feature: Ceres CLONE 101655389
  misc_feature: Encodes the peptide sequence at SEQ ID NO. 96828
ggaagccagtgcacgtcgaccgacgcacgccaccatgccggggctcaccatcggcgacaccgtccccaacctggagctggactccacccacggcaagatccgcatccacgactacgttggcgacggctacgccatcatcttctctcacccagccgacttcacgcccgtgtgcacgacggagatggcggcgatggcggggtacgccaaggagttcgagaagcgtggcgtgaagctgctgggcatctcgtgcgacgacgtggagtcgcacaggcagtggaccaaggacgtggaggcgtacggcgggaagcagcagacgacaacgacgaaggtgacgttcccgatcctcgcggacccggcgcgggacgccatccggcagctgaacatggtggaccccgacgagaaggacgcggcggggcggagcatgccgtcccgcgcgctccacgtcgtcgggcccgacaaggccgtgaagctgagcttcctgtacccggccaccacggggcggaacatggacgaggtgctgcgcgccgtcgactcgctgctcaccgccgccaagcacggcgggaaggtggccacgcccgccaactggaagcccggggagtgcgccgtcatcgcgcccggcgtctccgatgaggaggccaggaagatgttcccgcaggggttcgagaccgccgacctgccctccaagaagggctacctccgcttcaccaaggtctagctagccggcggcacggacgtctagctagctcgtctgtcgatcagtccgcgtcgaccggctggtggtttctctgactagtatatatataggctctaagtatgtgtgtgtactatgccgtgccgtgttgtctaccgcgctagtattgtccacccatgcatatcagtgtcctcttaggaaaaaaaaaaaaaaaaaaaaa

SEQ ID NO: 96828 - protein, 226 aa, Zea mays
  misc_feature: Ceres CLONE 101655389
  misc_feature (6)..(147): Pfam Name: AhpC-TSA Pfam Description: AhpC/TSA family
  misc_feature: SWISSPROT Homolog: EC 1.11.1.15 Peroxiredoxin
MPGLTIGDTVPNLELDSTHGKIRIHDYVGDGYAIIFSHPADFTPVCTTEMAAMAGYAKEFEKRGVKLLGISCDDVESHRQWTKDVEAYGGKQQTTTTKVTFPILADPARDAIRQLNMVDPDEKDAAGRSMPSRALHVVGPDKAVKLSFLYPATTGRNMDEVLRAVDSLLTAAKHGGKVATPANWKPGECAVIAPGVSDEEARKMFPQGFETADLPSKKGYLRFTKV

SEQ ID NO: 96829 - DNA, 946 bp, Zea mays
  misc_feature: Ceres CLONE 101655547
  misc_feature: Encodes the peptide sequence at SEQ ID NO. 96830
gaaacgcaccaagcgaagcgcactagcaacgacctaacaacaatggctaccaagatattagccctccttgcgctttttgtgagcgcaacaaatgcgttcattattccacaatgctcacttgctcctagtgccattattccacagttcctcccaccagttacttgggtgggcttcgaacacctagctgtgcaagccaacatgcaacaacaagcgcttgcggcgagcgtcttacaacaaccaattgcccaattgcaacaacaatccttgccacatctaacaatacaagccatcacaacgcaacagcaacaacagttcctaccagcactgagccacctagccatggtgaaccctgccgcctacttgcaagagcagctgcttgcatccaacccacttgctctggcgaacgtagttgcaaaccagcaacaacaacagctacaacagtttctgccaacgctcagtcaactagccatggtgaaccctgccgcctacgtacaacaacaacaactgctttcatctagcccgctcgctgtgggcaatgcacctacatacctgcaacaacaattgttgcaacagattgtaccagctctgactcaactagctgtggcaaaccctgttgcctacttgcaacagctgcttccattcaaccaactgactctgtcgaactttgctgggtacctacaacagcgacaacagttacttaatccattggtagtggctaacccattggtcccccccttcctacagcagcaacaattgctgccatacaaccagttctctttgatgaatcctgtcttgtcgaggcagcaacccatcgttggaggtgccatcttttagattacatatgagatgtactcgataatggtgccctcataccgacgtgtgcttcccacaaataatcaatatattgattgagatttatctcgataaaaaaaaaaaaaaaaaaaaa

SEQ ID NO: 96830 - protein, 263 aa, Zea mays
  misc_feature: Ceres CLONE 101655547
  misc_feature (1)..(263): Pfam Name: Zein Pfam Description: Zein seed storage protein
MATKILALLALFVSATNAFIIPQCSLAPSAIIPQFLPPVTWVGFEHLAVQANMQQQALAASVLQQPIAQLQQQSLPHLTIQAITTQQQQQFLPALSHLAMVNPAAYLQEQLLASNPLALANVVANQQQQQLQQFLPTLSQLAMVNPAAYVQQQQLLSSSPLAVGNAPTYLQQQLLQQIVPALTQLAVANPVAYLQQLLPFNQLTLSNFAGYLQQRQQLLNPLVVANPLVPPFLQQQQLLPYNQFSLMNPVLSRQQPIVGGAIF

SEQ ID NO: 96831 - DNA, 826 bp, Zea mays
  misc_feature: Ceres CLONE 101656622
  misc_feature: Encodes the peptide sequence at SEQ ID NO. 96832
agaaagcacaatattgtaccaataatggcagccaaaatattttgcctcattatgctccttggtctttctgcaagtgctgctacggcgagcattttcccgcaatgctcacaagctcctatagcttcccttcttcccccatacctctcaccagcgatgtcttcagtatgtgaaaatccaattcttctaccctacaggatccaacaggcaatcgcagcaggcatcttacctttatcacccttgttcctccaacaatcatcagccctattacagcagttacctttggtgcatttattggcacaaaacatcagggcacaacaactacaacaactcgtgctagcaaaccttgctgcctactctcagcaacagcagttacctttggtgcatttgttggcacaaaacatcagggcacaacaactacaacaactcgtgctagcaaaccttgctgcctactctcagcaacaacagtttctgccattcaaccaactagctgcattgaactctgctgcttatttgcagcaacaacaactactaccattcagccagctagctgctgtgagccctgctgccttcttgacacagcaacatttgttgccgttctacctgcacactgcgcctaacgttggcaccctcttacaactgcaacaattgctgccattcgaccaacttgctttgacaaacccagcagtgttctaccaacaacccatcattggtggtgccctcttttagattgcttatgagttatagttcaataataaagttttttttgctgatatttgtggcttcccagaaataagaaagtacatttctaaaaaaaaaaaaaaaaaaa

SEQ ID NO: 96832 - protein, 233 aa, Zea mays
  misc_feature: Ceres CLONE 101656622
  misc_feature (1)..(233): Pfam Name: Zein Pfam Description: Zein seed storage protein
MAAKIFCLIMLLGLSASAATASIFPQCSQAPIASLLPPYLSPAMSSVCENPILLPYRIQQAIAAGILPLSPLFLQQSSALLQQLPLVHLLAQNIRAQQLQQLVLANLAAYSQQQQLPLVHLLAQNIRAQQLQQLVLANLAAYSQQQQFLPFNQLAALNSAAYLQQQQLLPFSQLAAVSPAAFLTQQHLLPFYLHTAPNVGTLLQLQQLLPFDQLALTNPAVFYQQPIIGGALF

SEQ ID NO: 96833 - DNA, 841 bp, Zea mays
  misc_feature: Ceres CLONE 101678290
  misc_feature: Encodes the peptide sequence at SEQ ID NO. 96834
tcaactaccaaactctgctcctccctgcttccgtcacgcgagagcactccactcccacgcgaaccctagcagggttctccctcggggccccgctaagcagcttggttccaagctgtagaagcatctccgatcccatccgcggcgggttgaggccatcagctccggtttctgcagccggatttgggatccgcgagatgtcttggtccgcgcccgacgacatcctcctctccacctccctcgccggcttcttggacaagaaacttattgtcctgctaagagatggacggaaactgcttggcaccctctgctcatttgatcagtttggttttgcagcaaatgttgttcttcagggtgcttgtgaacgagtgattgtgggggaacaatattgtgatgttcctcttgggctgtacgtaatccggggagagaacgttgttttaatcggagaattggatcgcgaaaaggatgaactccctgctcacatgacctgtgtttcagaagcagaaataagaaaggctgaaaaggcagaacgggaagccagagatctgaaagggacgatgaggaaacggatggagttcctggacttcgattaacaccgtcaccgcggccgttgccgctccccattgtggcggaatctttagtggcggcctgtgtgccatacatgcctggtgaccgcgccggcgcaccttggattgctggagggtttagcgaacagtttctttttaactagcagtgctgttttatactctcgtggccacagaccctttgagcgcctcctgatacagctttgtcaccactctgatcattgcctcgatgaatttatatacctgacgttttggatgat

SEQ ID NO: 96834 - protein, 131 aa, Zea mays
  misc_feature: Ceres CLONE 101678290
  misc_feature (13)..(84): Pfam Name: LSM Pfam Description: LSM domain
MSWSAPDDILLSTSLAGFLDKKLIVLLRDGRKLLGTLCSFDQFGFAANVVLQGACERVIVGEQYCDVPLGLYVIRGENVVLIGELDREKDELPAHMTCVSEAEIRKAEKAEREARDLKGTMRKRMEFLDFD

SEQ ID NO: 96835 - DNA, 1212 bp, Zea mays
  misc_feature: Ceres CLONE 101687283
  misc_feature: Encodes the peptide sequence at SEQ ID NO. 96836
cagaacatgccggccatgggtggactctaccagtaccagctgcccagctaccgcaccaacccctgtggcgtctccgctgccattccgccctactactgattcatgatatttgggaaatctcctctatccatctctctctatctatatatgtaataatgcagtaagacgacacacattatcatgtgtggtatgaccaataatatatgcatggtcataataaagttttggttttaatgaatcaaaaaaaaaaaaaaaaaaaaaaaaaaaaaaaaaaaactcgagactagttctctcattcagaaacacacctagcgaagcgcactagcaacgacctaacaacaatggctaccaagatattatccctctttgcgcttcttgccctttttgtgagcgcaacaaatgcgttcattattccacaatgctcacttgctcctagtgccattattccacagttcctccctccagttacttcaatgggcttcgaacacccagctgtgcaagcctacaggctacaacaagcgcttgcggcgagcgtcttacaacaaccaattgcccaattacaacaacaatccttggcacatctaaccatacaaaccatcgcaacgcaacagcaacaacaatttctaccagcactgagccaactagctgtggtgaaccctgtcgcctacttgcaacagcagttgcttgcatccaacccacttgctctggcaaacatagttgcataccaacaacaacaacaattgcaacagtttctaccagcgctcagtcaactagccatggtgaaccctgccgcctacctacaacagcaacaactgatttcatctagccctctcgctgtggttaatgcacctacatacctgcaacaacagttgctgcaacagattgtaccagctctgactcagctagctgtggcaaaccctgctgcctacttgcaacagctgcttccattcaaccaactgactgtgtcgaactctgctgcgtacctacaacagcgacaacagttacttaatccactagcggtggctaacccattggtcgctgccttcctacagcagcaacaattgctgccatacaaccagttctctttgatgaaccctgccttgttgtggcagcaacccatcgttggaggtgccatcttttagattacatatgagatgtactcgataatggtgccctcatagcggcatgtgtttcctagaaataatcaatata

SEQ ID NO: 96836 - protein, 266 aa, Zea mays
  misc_feature: Ceres CLONE 101687283
  misc_feature (1)..(266): Pfam Name: Zein Pfam Description: Zein seed storage protein
MATKILSLFALLALFVSATNAFIIPQCSLAPSAIIPQFLPPVTSMGFEHPAVQAYRLQQALAASVLQQPIAQLQQQSLAHLTIQTIATQQQQQFLPALSQLAVVNPVAYLQQQLLASNPLALANIVAYQQQQQLQQFLPALSQLAMVNPAAYLQQQQLISSSPLAVVNAPTYLQQQLLQQIVPALTQLAVANPAAYLQQLLPFNQLTVSNSAAYLQQRQQLLNPLAVANPLVAAFLQQQQLLPYNQFSLMNPALLWQQPIVGGAIF

SEQ ID NO: 96837 - DNA, 1489 bp, Zea mays
  misc_feature: Ceres CLONE 101691969
  misc_feature: Encodes the peptide sequence at SEQ ID NO. 96838
ctagactaacctgattccgcctagcaacaaatccgtctcccgagtccggcgaaggcactatccgagtttacttcacactcgtgcacccatccgggtcactggctcactgccaccgcgccccaatcacgcgcgcgccacccgcgatgatggcggcggcggcgatctccggctccagcggccacctcgtcgtctcctccccccgcttcaggcagccgctcacgctcccttctcgcagcggtcgcccaatcgccgccgccgcctcgcccgtggcccgcggcggggtctcggtcgccgccgtgtccagccccgctgtgtcggccgtcgcggggaaggatgccaaacaggctcctaaggatttccttcatatcaatgattttgacaaggatacaataatgaatatccttaatcgagcgatcaaggttaaggcagcgataaagtctggagacaggagcttccaaccattcaatgggaaatcaatggcgatgatttttgccaagccatcaatgaggacccgtgtttcatttgaggcgggattcttcttgcttggtgggcatgctatttatttgggtccagatgatatccagatgggcaagcgtgaggagactcgtgatgttgctcgagtactttctggctataatgatatcattatggccagggtctttgctcatcaggatattctggacttggcaaaatatgcagctgtacctgtcataaatggtctcaccgactataaccatccatgccagataatggctgatgcacttactatgcttgagcacgttggtcgcattgagaacactaaggttgtctatgttggagatgggaacaacattgtgcactcgtggcttctattggctgctgtacttccttttcactttgtatgtgcttgtcccaagggatttgagcccgatgcaaagacagtggaggtcgccaggagtgctggaatcagtaagattgaaataccaaacgatcccagggaagcagttaagggagcagatgttgtgtatacagatgtttgggccagcatgggccagaaggaagaagctgattatagaaaccagaagttccagggattcccggtggatgaacccctgatggagattgctggcccccaggcctcccttatgcactgtttccccccagagagaggagtggaggtgacagacggtgccatcgaggctccaaattcaatcgtgttcccccaggctgagaacagaatgcacgctcagaacgccatcatgcttcacgttctcggtgcttaaccctcctattgcaccccagtgtttaacttttcttgaatttgcttagggattgaggctgttttggctttagggcatgtatgagagcttaatttagcgaactgttcagtaacgtggtaactgttcttcagggtgggagtttgttgttcaaggaaagtttggcaccctgaataaaaaaataatccttagaggggtttttactgagccgcaaaaaaaaaaaaaaaaaaaaa

SEQ ID NO: 96838 - protein, 372 aa, Zea mays
  misc_feature: Ceres CLONE 101691969
  misc_feature (70)..(212): Pfam Name: OTCace_N Pfam Description: Aspartate/ornithine carbamoyltransferase, carbamoyl-P binding domain
  misc_feature (216)..(369): Pfam Name: OTCace Pfam Description: Aspartate/ornithine carbamoyltransferase, Asp/Orn binding domain
  misc_feature: SWISSPROT Homolog: EC 2.1.3.3 Ornithine carbamoyltransferase
MMAAAAISGSSGHLVVSSPRFRQPLTLPSRSGRPIAAAASPVARGGVSVAAVSSPAVSAVAGKDAKQAPKDFLHINDFDKDTIMNILNRAIKVKAAIKSGDRSFQPFNGKSMAMIFAKPSMRTRVSFEAGFFLLGGHAIYLGPDDIQMGKREETRDVARVLSGYNDIIMARVFAHQDILDLAKYAAVPVINGLTDYNHPCQIMADALTMLEHVGRIENTKVVYVGDGNNIVHSWLLLAAVLPFHFVCACPKGFEPDAKTVEVARSAGISKIEIPNDPREAVKGADVVYTDVWASMGQKEEADYRNQKFQGFPVDEPLMEIAGPQASLMHCFPPERGVEVTDGAIEAPNSIVFPQAENRMHAQNAIMLHVLGA

SEQ ID NO: 96839 - DNA, 734 bp, Zea mays
  misc_feature: Ceres CLONE 101700685
  misc_feature: Encodes the peptide sequence at SEQ ID NO. 96840
gctctagggtttttgccacgccgccgccgctctgccccttccaccccaccgatataccaagatgacggcgcaggctgcggaggagctcgccgcccagatcgagcagcagaagctcgaggagcagaagaacgaggcagaagaggttgtggtggaggatgatgacaaggatgatgatgaactggatggacaagaaggggatgggagtggcaagtcgaagcaaagcaggagtgagaagaagagccgcaaggccatgctgaagcttggcatgaagcccatcactggtgtcagccgggtcactgtgaagaaaagcaagaatatgctttttgtcatctcgaagccagatgtgttcaagagcccaaactcggacacctatgtcatattcggcgaggcgaagatcgaggacctcagctcccagctgcagacccaagctgcagagcagttcaaggctcctgacctgagccaaatgatcccgaagcctgagacatctggcctgggcctggaggacaacgaggaggaggaggttgacgaaactggtgtcgaggccaaggatgtcgagctggtgatgactcaggcatctgtttcgaggcccagggcggtcaaggccctcaaagcttctaatggagacatcgtcaccgccattatggagctgactacttagtgttatttttgtcaacccccctttcttttaagcatgtatcgtatgccatgcagcttgagcggatatctgtggacac

SEQ ID NO: 96840 - protein, 198 aa, Zea mays
  misc_feature: Ceres CLONE 101700685
  misc_feature (55)..(114): Pfam Name: NAC Pfam Description: NAC domain
  misc_feature (159)..(196): Pfam Name: UBA Pfam Description: UBA/TS-N domain
MTAQAAEELAAQIEQQKLEEQKNEAEEVVVEDDDKDDDELDGQEGDGSGKSKQSRSEKKSRKAMLKLGMKPITGVSRVTVKKSKNMLFVISKPDVFKSPNSDTYVIFGEAKIEDLSSQLQTQAAEQFKAPDLSQMIPKPETSGLGLEDNEEEEVDETGVEAKDVELVMTQASVSRPRAVKALKASNGDIVTAIMELTT

SEQ ID NO: 96841 - DNA, 1206 bp, Zea mays
  misc_feature: Ceres CLONE 101985188
  misc_feature: Encodes the peptide sequence at SEQ ID NO. 96842
ctcagccgccgcgtgcctcccagtctcccgccctcgcctctctcttcctctcctctctccctgcgcgccgccgccgtgcctcgccttgcccagagactaaggcgccaggatagtataaatttagttcacgtgattgtggacttctcgccttttggattcaacattttctgcttctcagctctggaatacagaagtgccattgtgggctcaagaggataatgtacgggaggcgtgcatcgcagctgctgaaggagatcgactcctctgaggctggccagctcgtgccattcaacagtgacgtgtttgatcaagtgattagagagtgcaatgagcacaactcacaatttcaatcgttgatcaggaaaatggtggagcaaaacttagatatcgagacaactagaaatgaagatcactatggtgcagctatccaccatctttccctgctccgtaacaaaagatgccttatggcttacatgtacaaaactaaaagttcacagtacaaccgagcagaagttatccagagttttagatggaaaattggccctgtgcttcctcatgacatacaagaaaagctccatttctcagaaaaggagtacttcaagaaccactctgcagccattaaatcatacatatcagagatggatatagatttgacagtggacatggttcctcccaaggatccttacattcaggttcgggtgctggaggacattggtgaagtatcgctcggtgaccattctgtgtcattgaccaagaactcactccatttcctaaggcgcacagacgctgaacagtttatatcacagggtcttatggaagaatttttggagtagggatcacatgtatgaatgtatgatggtacaataggatggtgcactgccctcgttctccccagcgatgctgcctgatgccctatttgcaacaatgaaaagacgcgttctgtaccaaggagctttttaactagtcgctggacgatgatttcgaaagttgtgcaggcagtcctatactagattcattgcctctatttacatgtggatgacttttagttagtgtgccatccaagaaagcagatgttgcaaacattgtaacttgtgtattaacattggttttgctggtagatttcatatttgtgtttccaagattccatgtaatcaagaaaaaaaatgaaatcttggttgaaaaaaaaaaaaaaaaaaaaaaaaaaag

SEQ ID NO: 96842 - protein, 204 aa, Zea mays
  misc_feature: Ceres CLONE 101985188
  misc_feature (1)..(202): Pfam Name: Psf1 Pfam Description: Partner of SLD five, PSF1
MYGRRASQLLKEIDSSEAGQLVPFNSDVFDQVIRECNEHNSQFQSLIRKMVEQNLDIETTRNEDHYGAAIHHLSLLRNKRCLMAYMYKTKSSQYNRAEVIQSFRWKIGPVLPHDIQEKLHFSEKEYFKNHSAAIKSYISEMDIDLTVDMVPPKDPYIQVRVLEDIGEVSLGDHSVSLTKNSLHFLRRTDAEQFISQGLMEEFLE

SEQ ID NO: 96843 - DNA, 919 bp, Zea mays
  misc_feature: Ceres CLONE 101985964
  misc_feature: Encodes the peptide sequence at SEQ ID NO. 96844
tttgtaaaggtacgaggagcaaggtgaggcaccaccagtaccaaccgggctccgagttcatcacgcacgcatggaaggctcggcggcacaggcgccggggaagaccgtcctgagggtggtggcgatctccggctcgctgcgcagggcgtcggccaacaccggcctcatccgcgccgccgcggagatctgcagggagtcgatcccggggctggaggtggagcacgtggacatctcggagctgccgctgctgaacaccgacctggagggcccgggccccggcgcgttcccggcggccgtcgaggcgttccgcggcaaggtgcgcgccgccgactgcttcctgttcgcgtcgcccgagtacaactactccatctcgggcccgctcaagaacgcgctggactgggggtcgcgcccgcccaactgctggggcgacagggccgccgccatcctcagcgcgtcgggcgggtcggggggcagccgctcgcagtaccacgtccgccaggtcggcgtcttcctcgacctccacttcgtcaacaagcccgaggtgttcaccagggcgcaccagccgcccagcaagttcgacgacgacggcaacctcgtcgacccggacaccaaggaccaggtcaccaaggtgctcctggcgctgcaggctctcgcgctcaggctgcacctggggaagctcgctgttgctgcacactcttcttgaacgtcgtcgtcgtcgggggtgcactaaactacactacacatcgtcgccgagctccaaatgccgtgccgtgtccgtgtgtgcgcgcttcaataaattctcggcgtccaacttttaatgagtgatgcacaatcgtgttcatttgtgagatgccctgatcgaatcgatccgtttgcgttttgccacgatcatcaaaaaaaaaaaaaaaaaaaaaaaaag

SEQ ID NO: 96844 - protein, 210 aa, Zea mays
  misc_feature: Ceres CLONE 101985964
  misc_feature (14)..(182): Pfam Name: FMN_red Pfam Description: NADPH-dependent FMN reductase
  misc_feature: SWISSPROT Homolog: EC 1.6.5.2 NAD(P)H dehydrogenase (quinone)
MEGSAAQAPGKTVLRVVAISGSLRRASANTGLIRAAAEICRESIPGLEVEHVDISELPLLNTDLEGPGPGAFPAAVEAFRGKVRAADCFLFASPEYNYSISGPLKNALDWGSRPPNCWGDRAAAILSASGGSGGSRSQYHVRQVGVFLDLHFVNKPEVFTRAHQPPSKFDDDGNLVDPDTKDQVTKVLLALQALALRLHLGKLAVAAHSS

SEQ ID NO: 96845 - DNA, 776 bp, Zea mays
  misc_feature: Ceres CLONE 102035091
  misc_feature: Encodes the peptide sequence at SEQ ID NO. 96846
actccgacacaggatgtggcctacattgctggatctgctgctacattggtggtgccactgatctggtaccttgggccccccagatcacgagcatggacagaactgccaataatgcggtattggatatcgagggccttcctcaaccgcctgataaatgctgctctgggagtccgaagatgatcagggccttgtcgcgtaagggttcgaaccggatggagcggaggggcggcggcggcggcggcgacgagcaggagcaagaggatttggcgaaaaaacttgtcatcaaagttgtgccgtctcaactggagcagcagcccctgggtcagaacaaggcgctggtcgctccacattgcacacctgttcttgttgattctggggaagggaggagcaaaagattcattagccggttcacgtccatcaaccctcggaagattctcctcttgttcgcaacgctgtcgagcgtggggacaacgatactgatctacttcacgctggcgatcaacagcaaagcggaggcctagtcgcctggagacacccaccaccaccatttgcgtcggcgggcgggcggcggcagtacattccgagcttgagtttttatttttctctatttttgtttgtgaggtagctgccgcggcgagattagatgcagcctgccgctcaggtgtctgtatccattgactgagtgagagactgcttcagtgggtgtcattcttcctcgcgtgtatgtatattggtggaatcgttgatgtgacttttttagtcttcaattctgcgca

SEQ ID NO: 96846 - protein, 142 aa, Zea mays
  misc_feature: Ceres CLONE 102035091
MDRTANNAVLDIEGLPQPPDKCCSGSPKMIRALSRKGSNRMERRGGGGGGDEQEQEDLAKKLVIKVVPSQLEQQPLGQNKALVAPHCTPVLVDSGEGRSKRFISRFTSINPRKILLLFATLSSVGTTILIYFTLAINSKAEA

SEQ ID NO: 96847 - protein, 425 aa, Panicum virgatum
  misc_feature: Useful for making plants with altered carbohydrate content
MGTGTGGARGGAGGGGLVPGERWWRVLFLALASVSFLISLILLFLSAPRLRLPGVAPSASTSAASAVRRGLDAPPCLAYLLIGARGDGRRLLRLLLAVYHPRNRYVLHLSADAPDDERQSLAAGVVAAAPAVGAFENVAVVGNPTAGTLVGSSGLAGTLRAAAVLLRLHPDWDWFLTLNAADYPLVTQDDLIHVLSSVPRDLNFIDHTSNIGSKEPEKVEQIIVDAGIYLSGRTNFFRGTQKRPAPVAFKFFTGSPWVILNRRFIEYCILAWENLPRILLMYFNNIIQPQEGYFHSVICNSLEFRNFTVNNDLRFIPREDPAQKEPPFLSREHYSQMVDSGAPFARPFRENDPLLDQIDGNILKRWSHGPVPGAWCSGRKRWFSDPCSQWGDVNIVRPGPQAVKLHQYVNRTLQEAKSSSNTCRQ

SEQ ID NO: 96848 - protein, 456 aa, Arabidopsis thaliana
  misc_feature: Useful for making plants with altered cell wall content and/or composition
MALSILFLLLFILFSISPSNAQSFIGVNYGLLSDNLPPPSQTAKLLQSTSIQKVRLYNADSSIITSLVGTGIGIVIGVANGDLPSIASDLNIASQWINSNVLPFYPASNIILINVGNEVLLSNDLNLVNQLLPAMQNVQKALEAVSLGGKIKVSTVHAMTVLGNSEPPSAGSFAPSYQAGLKGILQFLSDTGSPFAINPYPFFAYQSDPRPETLAFCLFQPNPGRVDSNTGIKYMNMFDAQVDAVHSALKSIGFEKVEVLVAETGWPSTGDSNEVGPSVENAKAYNGNLIAHLRSMVGTPLMPGKSIDTYIFALFDENLKPGPSFEQSFGLFKPDLSMAYDIGLTKTTSSQTSQSPQLGKVTSMGWCVPKEDATQEQLQDSLDWVCGQGIDCGPIMPGGVCFEPNNVASHTAYAMNLYFQKSPENPTDCDFSKTARITSENPSKLFSSSSFISYLL

SEQ ID NO: 96849 - protein, 181 aa, Arabidopsis thaliana
  misc_feature: Useful for making plants with altered alkaloid content
  misc_feature: Useful for making plants with altered lignin content
MGLSFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 96850 - protein, 94 aa, Zea mays
  misc_feature: Useful for making plants with altered terpenoid content
MGQAFRKLFDSFFGTSEMRVVMLGLDAAGKTTILYKLHIGEVLSTVPTIGFNVEKVQYKNVMFTVWDVGGQEKLRVTTSAKEMSLGISPLEGVQ

SEQ ID NO: 96851 - protein, 182 aa, Arabidopsis thaliana
  misc_feature: Useful for making plants with modulated nitrogen use efficiency
MGILFTRMFSSVFGNKEARILVLGLDNAGKTTILYRLQMGEVVSTIPTIGFNVETVQYNNIKFQVWDLGGQTSIRPYWRCYFPNTQAVIYVVDSSDTDRIGVAKEEFHAILEEDELKGAVVLIFANKQDLPGALDDAAVTEALELHKIKSRQWAIFKTCAVKGEGLFEGLDWLSNTLKSGSG

SEQ ID NO: 96852 - protein, 145 aa, Arabidopsis thaliana
  misc_feature: Useful for biocontainment applications
  misc_feature: Useful for making plants with modulated flowering time
MAKADKKPAEKKPAEKTPAAEPAAAAEKKPKAGKKLPKEPAVAGDKKKKRSKKNVETYKIYIFKVLKQVHPDIGISSKAMGIMNSFINDIFEKLAGESSKLARYNKKPTITSREIQTAVRLVLPGELAKHAVSEGTKAVTKFTSS

SEQ ID NO: 96853 - protein, 78 aa, Zea mays
  misc_feature: Useful for making plants with modulated salt sensitivity
MGPRYITLCIFLVLVLHGDTTLAETCRQFVKWDPFCFSAMCKASCFIEGKSSDGSYVKGHRCESNGYHAVCVCFLCKN

SEQ ID NO: 96854 - protein, 112 aa, Arabidopsis thaliana
  misc_feature: Useful for making plants with modulated biomass
MAGISRVLGGFRTLMSKAATVEAVTVAGEGKGIFKTRPVSQQLASFAGERELTRGSALKKVWEYVKLHNLQNPANKKEIHCDDKLKTIFDGKDKVGITEIMKLLSPHFPKSV

SEQ ID NO: 96855 - protein, 275 aa, Arabidopsis thaliana
  misc_feature: Useful for making plants with modulated water use efficiency
MATTTAAAAGIFGIRIQDPRPGTGRVQARFGFSFGKKKPAPPPKKSRQVQDDGDRLVWFPGANPPEWLDGSMIGDRGFDPFGLGKPAEYLQYDFDGLDQNLAKNVAGDIIGIIQESSEIKPTPFQPYTEVFGIQRFRECELIHGRWAMLGTLGAIAVEALTGIAWQDAGKVELVEGSSYLGQPLPFSLTTLIWIEVLVVGYIEFQRNSELDPEKRIYPGGYFDPLGLAADPEKLDTLKLAEIKHSRLAMVAFLIFALQAAFTGKGPVSFLATFNN

SEQ ID NO: 96856 - protein, 275 aa, Arabidopsis thaliana
  misc_feature: Useful for making plants with modulated biomass
  misc_feature: Useful for making plants with modulated drought sensitivity
  misc_feature: Useful for making plants with modulated phosphate use efficiency
MATTTAAAAGIFGIRIQDPRPGTGRVQARFGFSFGKKKPAPPPKKSRQVQDDGDRLVWFPGANPPEWLDGSMIGDRGFDPFGLGKPAEYLQYDFDGLDQNLAKNVAGDIIGIIQESSEIKPTPFQPYTEVFGIQRFRECELIHGRWAMLGTLGAIAVEALTGIAWQDAGKVELVEGSSYLGQPLPFSLTTLIWIEVLVVGYIELQRNSELDPEKRIYPGGYFDPLGLAADPGKLDTLKLAEIKHSRLAMVAFLIFALQAAFTGKGPVSFLATFNN

SEQ ID NO: 96857 - protein, 273 aa, Arabidopsis thaliana
  misc_feature: Useful for making plants with modulated nitrogen use efficiency
  misc_feature: Useful for making plants with modulated oxidative stress sensitivity
MSIEEENVPTTVDSGAADTTVKSPEKKPAAKGGKSKKTTTAKATKKPVKAAAPTKKKTTSSHPTYEEMIKDAIVTLKERTGSSQYAIQKFIEEKHKSLPPTFRKLLLVNLKRLVASEKLVKVKASFKIPSARSAATPKPAAPVKKKATVVAKPKGKVAAAVAPAKAKAAAKGTKKPAAKVVAKAKVTAKPKAKVTAAKPKSKSVAAVSKTKAVAAKPKAKERPAKASRTSTRTSPGKKVAAPAKKVAVTKKAPAKSVKVKSPAKRASTRKAKK

SEQ ID NO: 96858 - protein, 33 aa, Arabidopsis thaliana; identical to SEQ ID NO: 94826
  misc_feature: Useful for making plants with modulated cold sensitivity

SEQ ID NO: 96859 - protein, 379 aa, Arabidopsis thaliana
  misc_feature: Useful for making plants with modulated heat sensitivity
MATQGQVITCKAAVAYEPNKPLVIEDVQVAPPQAGEVRIKILYTALCHTDAYTWSGKDPEGLFPCILGHEAAGIVESVGEGVTEVQAGDHVIPCYQAECRECKFCKSGKTNLCGKVRSATGVGIMMNDRKSRFSVNGKPIYHFMGTSTFSQYTVVHDVSVAKIDPTAPLDKVCLLGCGVPTGLGAVWNTAKVEPGSNVAIFGLGTVGLAVAEGAKTAGASRIIGIDIDSKKYETAKKFGVNEFVNPKDHDKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNLTLGEINKAFDLLHEGTCLRCVLDTSK

SEQ ID NO: 96860 - protein, 423 aa, Arabidopsis thaliana
  misc_feature: Useful for making plants with modulated root development
MARKKIREYDSKRLVKEHFKRLSGKELPIRSVQINETTDLNELVEKEPWLSSEKLVVKPDMLFGKRGKSGLVALKLDFADVATFVKERLGKEVEMSGCKGPITTFIVEPFVPHNEEYYLNVVSDRLGCSISFSECGGIEIEENWDKVKTIFLPTGASLTPEICAPLVATLPLEIKAEIEEFIKVIFTLFQDLDFTFLEMNPFTLVDGSPYPLDMRGELDDTAAFKNFKKWGDIEFPLPFGRVMSPTESFIHGLDEKTSASLKFTVLNPKGRIWTMVAGGGASVIYADTVGDLGYASELGNYAEYSGAPKEDEVLQYARVVIDCATANPDGKSRALVIGGGIANFTDVAATFNGIIRALKEKEAKLKAARMHIFVRRGGPNYQKGLAKMRALGDDIGVPIEVYGPEATMTGICKEAIQYITAAA

SEQ ID NO: 96861 - protein, 294 aa, Arabidopsis thaliana [sequence omitted]

SEQ ID NO: 96862 - protein, 374 aa, Arabidopsis thaliana
  misc_feature: Useful for making plants with modulated low light sensitivity
MGRAPCCDKANVKKGPWSPEEDAKLKDYIENSGTGGNWIALPQKIGLRRCGKSCRLRWLNYLRPNIKHGGFSEEEDNIICNLYVTIGSRWSIIAAQLPGRTDNDIKNYWNTRLKKKLLNKQRKEFQEARMKQEMVMMKRQQQGQGQGQSNGSTDLYLNNMFGSSPWPLLPQLPPPHHQIPLGMMEPTSCNYYQTTPSCNLEQKPLITLKNMVKIEEEQERTNPDHHHQDSVTNPFDFSFSQLLLDPNYYLGSGGGGEGDFAIMSSSTNSPLPNTSSDQHPSQQQEILQWFGSSNFQTEAINDMFINNNNNIVNLETIENTKVYGDASVAGAAVRAALGGGTTSTSADQSTISWEDITSLVNSEDASYFNAPNHV

SEQ ID NO: 96863 - protein, 351 aa, Arabidopsis thaliana
  misc_feature: Useful for making plants with altered oil content
DDDDDDDDDEVDGDDNEKEKIGLYELKKGNLTVKFTNWGASIISLHFPDKNGKMDDIVLGYDSVKTYKTDKVYFGATVGRVANRIGKGKFKLNGKEYKTSVNDGKNTLHGGKKGFGDVVWAVAKHQYDGKKPHIVFTHTSPDGDQGFPGELSVTVTYKLVKDNELSVVMEAKPKDKATPVNLAHHSYWNLGGHNSGDILSEEIQILGSGYTPVDGELIPTGKINPVKGTAYDFLQLRPIKDNMKDLKTGYDINYCLDGKAKKMRKIVELVDKKSGRKMELSGNQAGLQFYTGGMLKDVKGKNGAVYQAFGGLCLETQSYPDALNHPKFPSQIVEPGKKYKHTMLFKFSIVS

SEQ ID NO: 96864 - protein, 182 aa, Arabidopsis thaliana
  misc_feature: Useful for making plants with modulated light quality sensitivity
MMTPGGSGRLRPLPTAMYAGYSGTASSWVAKTSVSASGKRIQREMAELNIDPPPDCSAGPKGDNLYHWIATIIGPSGTPYEGGIFFLDIIFPSDYPFKPPKLVFKTRIYHCNVDTAGDLSVNILRDSWSPALTITKVLQAIRSIFLKPEPYSPALPVIARLYLTDREKHDEVAKEWTLRFAK

SEQ ID NO: 96865 - protein, 248 aa, Arabidopsis thaliana
  misc_feature: Useful for making plants with enhanced nutritional value
  misc_feature: Useful for making plants with modulated heat sensitivity
MEGSSKGLRKGAWTTEEDSLLRQCINKYGEGKWHQVPVRAGLNRCRKSCRLRWLNYLKPSIKRGKLSSDEVDLLLRLHRLLGNRWSLIAGRLPGRTANDVKNYWNTHLSKKHEPCCKIKMKKRDITPIPTTPALKNNVYKPRPRSFTVNNDCNHLNAPPKVDVNPPCLGLNINNVCDNSIIYNKDKKKDQLVNNLIDGDNMWLEKFLEESQEVDILVPEATTTEKGDTLAFDVDQLWSLFDGETVKFD

SEQ ID NO: 96866 - protein, 524 aa, Arabidopsis thaliana
  misc_feature: Useful for making plants with modulated carbohydrate content
  misc_feature: Useful for making plants with modulated phosphate use efficiency
MAEQQLGVLKALDVAKTQLYHFTAIVIAGMGFFTDAYDLFCVSLVTKLLGRIYYFNPESAKPGSLPPHVAAAVNGVALCGTLSGQLFFGWLGDKLGRKKVYGLTLVMMILCSVASGLSFGHEAKGVMTTLCFFRFWLGFGIGGDYPLSATIMSEYANKKTRGAFIAAVFAMQGVGILAGGFVALAVSSIFDKKFPAPTYAVNRALSTPPQVDYIWRIIVMFGALPAALTYYWRMKMPETARYTALVAKNIKQATADMSKVLQTDIELEERVEDDVKDPKQNYGLFSKEFLRRHGLHLLGTTSTWFLLDIAFYSQNLFQKDIFSAIGWIPKAATMNATHEVFRIARAQTLIALCSTVPGYWFTVAFIDTIGRFKIQLNGFFMMTVFMFAIAFPYNHWIKPENRIGFVVMYSLTFFFANFGPNATTFIVPAEIFPARLRSTCHGISAAAGKAGAIVGAFGFLYAAQSQDKAKVDAGYPPGIGVKNSLIMLGVLNFIGMLFTFLVPEPKGKSLEELSGEAEVSHDEK

SEQ ID NO: 96867 - protein, 146 aa, Arabidopsis thaliana
  misc_feature: Useful for making plants with high aluminum sensitivity
  misc_feature: Useful for making plants with modulated high pH sensitivity
  misc_feature: Useful for making plants with modulated low iron sensitivity
  misc_feature: Useful for making plants with modulated phosphate use efficiency
MNLQAVSCSFGFLSSPLGVTPRTSFRRFVIRAKTEPSEKSVEIMRKFSEQYARRSGTYFCVDKGVTSVVIKGLAEHKDSYGAPLCPCRHYDDKAAEVGQGFWNCPCVPMRERKECHCMLFLTPDNDFAGKDQTITSDEIKETTANM

SEQ ID NO: 96868 - protein, 622 aa, Arabidopsis thaliana
  misc_feature: Useful for making plants with altered protein content
MAMAVFKAPLKGEFHGARKMEGKQYKHHLLQQQSTGRRRVFVQTDTGCVLGVELDRNDNVHTVKKRLQIAFNFPTEESSLTFGDMVLKNDLSAVRNDSPLLLKRNLMHRSSSTPCLSPTGNDLQRKDRSGPIEILSHSPCFLSLKQTANDIVKAMKMGVEPIPVNGGLGGAYYFRDEKGQSVAIVKPTDEEPFAPNNPKGFVGKALGQPGLKPSVRVGETGFREVAAYLLDYDHFANVPPTALVKITHSVFNVNDGMDGNKSREKKKLVSSKIASFQKFVPHDFDASDHGTSSFPVASVHRIGILDIRILNTDRHGGNLLVKKLDDGGVGRFGQVELIPIDHGLCLPETLEDPYFEWIHWPQASIPFSEEELDYIQSLDPVKDCEMLRRELPMIREACLRVLVLCTVFLKEAAVFGLCLAEIGEMMTREFRAGEEEPSELEMLCIEAKRLTTEQDVLSPKSDGEGETEFQFDIDYNELDSVYGSETETDEFFAKNPFSNGRSSLGELKESIAEEEEDDEEEAKLTLSLSKLSTSMKNNLSNTMGSGYLKPPKDNQTDKALVSHKSANVQLPLSVNFVKLADMKEVEWVVFLERFQELLYSAFAERKTMTLRNTQRLGTSCKF

SEQ ID NO: 96869 - protein, 623 aa, Arabidopsis thaliana
  misc_feature: Useful for making plants with atered amino acid content
MEAVIQTRGLLSLPTKPIGVRSQLQPSHGLKQRLFAAKPRNLHGCLYPLTGTRNFKPLSQPCMGFRFPTKREAPSSYARRRRGCWRRSCLRRSDSAAVVASRKIFGVEVATLKKIIPLGLMFFCILFNYTILRDTKDVLVVTAKGSSAEIIPFLKTWVNLPMAIGFMLLYTKLSNVLSKKALFYTVIVPFIIYFGGFGFVMYPLSNYIHPEALADKLLTTLGPRFMGPIAILRIWSFCLFYVMAELWGSVVVSVLFWGFANQITTVDEAKKFYPLFGLGANVALIFSGRTVKYFSNLRKNLGPGVDGWAVSLKAMMSIVVGMGLAICLLYWWVNRYVPLPTRSKNKKEKPKMGTMESLKFLVSSPYIRDLATLVVAYGISINLVEVTWKSKLKAQFPSPNEYSAFMGDFSTCTGVATFTMMLLSQYVFNKYGWGVAAKITPTVLLLTGVAFFSLILFGGPFAPLVAKLGMTPLLAAVYVGALQNIFSKSAKYSLFDPCKEMAYIPLDEDTKVKGKAAIDVVCNPLGKSGGALIQQFMILSFGSLANSTPYLGMILLVIVTAWLAAAKSLEGQFNSLRSEEELEKEMERASSVKIPVVSQDESGNGSLGESPSSSPEKSAPTNL

SEQ ID NO: 96870 - protein, 72 aa, Arabidopsis thaliana
  misc_feature: Useful for making plants with modulated time to senescence
MAKPLGTTGEFFRRRDEWRKHPMLSNQMRHALPGIGIGVGAFCVYLVGEQIYSKLMAPSSQSSHQKQPAPSH

SEQ ID NO: 96871 - protein, 645 aa, Arabidopsis thaliana
  misc_feature: Useful for making plants with modulated light response
MDTNTSGEELLAKARKPYTITKQRERWTEDEHERFLEALRLYGRAWQRIEEHIGTKTAVQIRSHAQKFFTKLEKEAEVKGIPVCQALDIEIPPPRPKRKPNTPYPRKPGNNGTSSSQVSSAKDAKLVSSASSSQLNQAFLDLEKMPFSEKTSTGKENQDENCSGVSTVNKYPLPTKQVSGDIETSKTSTVDNAVQDVPKKNKDKDGNDGTTVHSMQNYPWHFHADIVNGNIAKCPQNHPSGMVSQDFMFHPMREETHGHANLQATTASATTTASHQAFPACHSQDDYRSFLQISSTFSNLIMSTLLQNPAAHAAATFAASVWPYASVGNSGDSSTPMSSSPPSITAIAAATVAAATAWWASHGLLPVCAPAPITCVPFSTVAVPTPAMTEMDTVENTQPFEKQNTALQDQNLASKSPASSSDDSDETGVTKLNADSKTNDDKIEEVVVTAAVHDSNTAQKKNLVDRSSCGSNTPSGSDAETDALDKMEKDKEDVKETDENQPDVIELNNRKIKMRDNNSNNNATTDSWKEVSEEGRIAFQALFARERLPQSFSPPQVAENVNRKQSDTSMPLAPNFKSQDSCAADQEGVVMIGVGTCKSLKTRQTGFKPYKRCSMEVKESQVGNINNQSDEKVCKRLRLEGEAST

SEQ ID NO: 96872 - protein, 317 aa, Arabidopsis thaliana
  misc_feature: Useful for making plants with modulated light quality response
MGIQETDPLTQLSLPPGFRFYPTDEELMVQYLCRKAAGYDFSLQLIAEIDLYKFDPWVLPNKALFGEKEWYFFSPRDRKYPNGSRPNRVAGSGYWKATGTDKIISTEGQRVGIKKALVFYIGKAPKGTKTNWIMHEYRLIEPSRRNGSTKLDDWVLCRIYKKQSSAQKQVYDNGIANAREFSNNGTSSTTSSSSHFEDVLDSFHQEIDNRNFQFSNPNRISSLRPDLTEQKTGFHGLADTSNFDWASFAGNVEHNNSVPELGMSHVVPNLEYNCGYLKTEEEVESSHGFNNSGELAQKGYGVDSFGYSGQVGGFGFM

SEQ ID NO: 96873 - protein, 859 aa, Arabidopsis thaliana
  misc_feature: Useful for making plants with modulated seed size
MASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 96874 - protein, 241 aa, Arabidopsis thaliana
  misc_feature: Useful for making plants with altered cell wall content and/or composition
  misc_feature: Useful for making plants with altered lignin content
  misc_feature: Useful for making plants with altered terpenoid content
  misc_feature: Useful for making plants with altered tocopherol content
MATKQEALAIDFISQHLLTDFVSMETDHPSLFTNQLHNFHSETGPRTITNQSPKPNSTLNQRKPPLPNLSVSRTVSTKTEKEEEERHYRGVRRRPWGKYAAEIRDPNKKGCRIWLGTYDTAVEAGRAYDQAAFQLRGRKAILNFPLDVRVTSETCSGEGVIGLGKRKRDKSSPPEEEKAARVKVEEEESNTSETTEAEVEPVVPLTPSSWMGFWDVGAGDGIFSIPPLSPTSPNFSVISVT

SEQ ID NO: 96875 - protein, 138 aa, Glycine max
  misc_feature: Useful for making plants with altered lutein content
  misc_feature: Useful for making plants with modulated biomass
  misc_feature: Useful for making plants with modulated flowering time
  misc_feature (72)..(72): Xaa is any aa, unknown, or other
  misc_feature (95)..(95): Xaa is any aa, unknown, or other
MEEESKEKKKDTKEEPRYRGVRRRPWGKFAAEIRDPARHGARVWLGTFLTAEEAARAYDRAAYEMRGALAVXNFPNEYPSCSSMNSSSTLAPSSXSSNSMLKSDHGKQVIEFECLDDKLLEDLLDCDDYAYEKDLPKN

SEQ ID NO: 96876 - protein, 159 aa, Arabidopsis thaliana
  misc_feature: Useful for making plants with altered sterol content
  misc_feature: Useful for making plants with altered terpenoid content
MKRIVRISFTDMEATDSSSSEDESPPSSRRRGKKLVKEIVIDHSDPPEVGKTRFKIRIPASLLAARNTTANKKKFRGVRQRPWGKWAAEIRCGRVKGRPERIWLGTFETAEEAALAYDNAAIQLIGPDAPTNFGRPDVDSAVVKKQDSDASGGASEEVV

SEQ ID NO: 96877 - protein, 239 aa, Arabidopsis thaliana
  misc_feature: Useful for making plants with modulated UV sensitivity
  misc_feature: Useful for making plants with modulated low light sensitivity
  misc_feature: Useful for making plants with modulated nitrogen use efficiency
MVDAKQVRFIIGVIGNVISFGLFAAPAKTFWRIFKKKSVEEFSYVPYVATVMNCMLWVFYGLPVVHKDSILVSTINGVGLVIELFYVGVYLMYCGHKKNHRRNILGFLALEVILVVAIILITLFALKGDFVKQTFVGVICDVFNIAMYGAPSLAIIKVVKTKSVEYMPFLLSLVCFVNAGIWTTYSLIFKIDYYVLASNGIGTFLALSQLIVYFMYYKSTPKEKTVKPSEVEISATERV

SEQ ID NO: 96878 - protein, 738 aa, Arabidopsis thaliana
  misc_feature: Useful for making plants with modulated biomass
  misc_feature: Useful for making plants with modulated biotic stress sensitivity
  misc_feature: Useful for making plants with modulated light response
  misc_feature: Useful for making plants with modulated root development
  misc_feature: Useful for making plants with modulated salt sensitivity
MEVCNCIEPQWPADELLMKYQYISDFFIAIAYFSIPLELIYFVKKSAVFPYRWVLVQFGAFIVLCGATHLINLWTFTTHSRTVALVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLRHQHPVEYTVPIQLPVINQVFGTSRAVKISPNSPVARLRPVSGKYMLGEVVAVRVPLLHLSNFQINDWPELSTKRYALMVLMLPSDSARQWHVHELELVEVVADQVAVALSHAAILEESMRARDLLMEQNVALDLARREAETAIRARNDFLAVMNHEMRTPMHAIIALSSLLQETELTPEQRLMVETILKSSNLLATLMNDVLDLSRLEDGSLQLELGTFNLHTLFREVLNLIKPIAVVKKLPITLNLAPDLPEFVVGDEKRLMQIILNIVGNAVKFSKQGSISVTALVTKSDTRAADFFVVPTGSHFYLRVKVKDSGAGINPQDIPKIFTKFAQTQSLATRSSGGSGLGLAISKRFVNLMEGNIWIESDGLGKGCTAIFDVKLGISERSNESKQSGIPKVPAIPRHSNFTGLKVLVMDENGVSRMVTKGLLVHLGCEVTTVSSNEECLRVVSHEHKVVFMDVCMPGVENYQIALRIHEKFTKQRHQRPLLVALSGNTDKSTKEKCMSFGLDGVLLKPVSLDNIRDVLSDLLEPRVLYEGM

SEQ ID NO: 96879 - protein, 587 aa, Arabidopsis thaliana
  misc_feature: Useful for making plants with altered carbon content
  misc_feature: Useful for making plants with altered nitrogen content
MEEKDVYTQDGTVDIHNNPANKEKTGNWKACRFILGNECCERLAYYGMGTNLVNYLESRLNQGNATAANNVTNWSGTCYITPLIGAFIADAYLGRYWTIATFVFIYVSGMTLLTLSASVPGLKPGNCNADTCHPNSSQTAVFFVALYMIALGTGGIKPCVSSFGADQFDENDENEKIKKSSFFNWFYFSINVGALIAATVLVWIQMNVGWGWGFGVPTVAMVIAVCFFFFGSRFYRLQRPGGSPLTRIFQVIVAAFRKISVKVPEDKSLLFETADDESNIKGSRKLVHTDNLKFFDKAAVKSQSDSIKDGEVNPWRLCSVTQVEELKSIITLLPVWATGIVFATVYSQMSTMFVLQGNTMDQHMGKNFEIPSASLSLFDTVSVLFWTPVYDQFIIPLARKFTRNERGFTQLQRMGIGLVVSIFAMITAGVLEVVRLDYVKTHNAYDQKQIHMSIFWQIPQYLLIGCAEVFTFIGQLEFFYDQAPDAMRSLCSALSLTTVALGNYLSTVLVTVVMKITKKNGKPGWIPDNLNRGHLDYFFYLLATLSFLNFLVYLWISKRYKYKKAVGRAHKCCSLEPIVQTFGNKVS

SEQ ID NO: 96880 - protein, 613 aa, Zea mays
  misc_feature: Useful for making plants with modulated yield
MLTATPLPHQLLATFLLVLASATQPAVPASTDRAALLAFRASLSPPSRAALSSWSGPLSPSWLGVSLHPATAPAPSVTTPSVAELSLRGLNLTGVIPAAPLALLRRLRTLDLSANALSGELPCSLPRSLLALDLSRNALSGAVPTCLPSSLPALRTLNLSANFLRLPLSPRLSFPARLAALDLSRNAISGAVPPRIVADPDNSALLLLDLSHNRFSGEIPAGIAAVRSLQGLFLADNQLSGDIPPGIGNLTYLQVLDLSNNRLSGSVPAGLAGCFQLLYLQLGGNQLSGALRPELDALASLKVLDLSNNKISGEIPLPLAGCRSLEVVDLSGNEISGELSSAVAKWLSLKFLSLAGNQLSGHLPDWMFSFPLLQWLDLSSNKFVGFIPDGGFNVSEVLNGGGGQGTPSESVLPPQLFVSASVDTVSWQLDLGYDVQATTGIDLSGNELCGEIPEGLVDMKGLEYLNLSCNYLAGQIPAGLGGMGRLHTLDFSHNGLSGEVPPGIAAMTVLEVLNLSYNSLSGPLPTTKFPGALAGNPGICSGKGCSENARTPEGKMEGSNHRGWLGGWHGENGWVSLGAFCISTMTSFYVSLATLLCSSNARNFVFRPVRVEY

SEQ ID NO: 96881 - protein, 130 aa, Arabidopsis thaliana
  misc_feature: Useful for making plants with altered glycerol content
MASPKSPTRPTQQNPQPNFHDFLPTMAGNLGGEGLIGELCNGFELLMDREKGVITFESLRRNAAAVLGLGDLTDEDVRCMIKEGDFDCDGALNQMEFCVLMFRLSPDLMEASRCLVTEVIEEEFGFTRRH

SEQ ID NO: 96882 - protein, 522 aa, Zea mays
  misc_feature: Useful for making plants with modulated plant growth and development
MSNGPFILNLDCDHYVYNSQAFREGMCFMMDRGGDRIGYVQFPQRFEGIDPSDRYANHNTVFFDVNMRALDGLMGPVYVGTGCLFRRVALYGFDPPRSKEHGGCCSCCFPQRRKIKASAAAPEETRALRMADFDEDEMNMSSFPKKFGNSSFLIDSIPIAEFQGRPLADHPGVKNGRPPGALTVPRDLLDASTVAEAVSVISCWYEDKTEWGHRVGWIYGSVTEDVVTGYRMHNRGWKSVYCVTKRDAFHGTAPINLTDRLHQVLRWATGSVEIFFSRNNALLASRRMKFLQRIAYLNVGIYPFTSIFLIVYCFLPALSLFSGQFIVKTLNVTFLTYLLVITLTLCLLAVLEIKWSGISLEEWWRNEQFWLIGGTSAHLAAVLQGLLKVVAGIEISFTLTSKSGGDDVDDEFADLYIVKWTSLMIPPIVIMMVNLIGIAVGFSRTIYSEIPQWSKLLGGVFFSFWVLAHLYPFAKGLMGRRGRTPTIVFVWAGLLSITISLLWVAINPPSQNQQIGGSFTFP

SEQ ID NO: 96883 - protein, 514 aa, Arabidopsis thaliana
  misc_feature: Useful for making plants with modulated carbon-nitrogen partitioning
MDTATTTCSAVDLSALLSSSSNSTSSLAAATFLCSQISNISNKLSDTTYAVDNTYLLFSAYLVFAMQLGFAMLCAGSVRAKNTMNIMLTNVLDAAAGAISYYLFGFAFAFGTPSNGFIGRHHSFFALSSYPERPGSDFSFFLYQWAFAIAAAGITSGSIAERTQFVAYLIYSTFLTGFVYPTVSHWFWSSDGWASASRSDNNLLFGSGAIDFAGSGVVHMVGGIAGLCGALVEGPRIGRFDRSGRSVALRGHSASLVVLGTFLLWFGWYGFNPGSFLTILKGYDKSRPYYGQWSAVGRTAVTTTLSGCTAALTTLFSKRLLAGHWNVIDVCNGLLGGFAAITSGCAVVEPWAAIVCGFVASWVLIGFNLLAKKLKYDDPLEAAQLHGGCGAWGLIFTGLFARKEYVNEIYSGDRPYGLFMGGGGKLLAAQIVQIIVIVGWVTVTMGPLFYGLHKMNLLRISAEDEMAGMDMTRHGGFAYAYNDEDDVSTKPWGHFAGRVEPTSRSSTPTPTLTV

SEQ ID NO: 96884 - protein, 2325 aa, Zea mays
  misc_feature: Useful for making plants with altered oil content
  misc_feature: Useful for making plants with modulated herbicide sensitivity
MSQLGLAAAASKALPLLPNRQRSSAGTTFSSSSLSRPLNRRKSHTRSLRDGGDGVSDAKKHSQSVRQGLAGIIDLPSEAPSEVDISHGSEDPRGPTDSYQMNGIINETHNGRHASVSKVVEFCAALGGKTPIHSILVANNGMAAAKFMRSVRTWANDTFGSEKAIQLIAMATPEDMRINAEHIRIADQFVEVPGGTNNNNYANVQLIVGMAQKLGVSAVWPGWGHASENPELPDALTAKGIVFLGPPASSMNALGDKVGSALIAQAAGVPTLAWSGSHVEVPLECCLDAIPEEMYRKACVTTTEEAVASCQVVGYPAMIKASWGGGGKGIRKVHNDDEVRALFKQVQGEVPGSPIFVMRLASQSRHLEVQLLCDQYGNVAALHSRDCSVQRRHQKIIEEGPVTVAPRETVKALEQAARRLAKAVGYVGAATVEYLYSMETGDYYFLELNPRLQVEHPVTEWIAEVNLPAAQVAVGMGIPLWQIPEIRRFYGMDYGGGYDIWRKTAALATPFNFDEVDSQWPKGHCVAVRITSEDPDDGFKPTGGKVKEISFKSKPNVWAYFSVKSGGGIHEFADSQFGHAFAYGLSRPAAITNMSLALKEIQIRGEIHSNVDYTVDLLNASDFRENKIHTGWLDTRIAMRVQAERPPWYISVVGGALYKTVTTNAATVSEYVSYLTKGHIPPKHISLVNSTVNLNIEGSKYTIETVRTGHGSYRLRMNDSTVEANVQSLCDGGLLMQLDGNSHVIYAEEEAGGTRLQIDGKTCLLQNDHDPSKLLAETPCKLLRFLVADGAHVDADVPYAEVEVMKMCMPLLSPASGVIHCMMSEGQALQAGDLIARLDLDDPSAVKRAEPFDGIFPQMELPVAVSSQVHKRYAASLNAARMVLAGYEHNINEVVQDLVCCLDNPELPFLQWDELMSVLATRLPRNLKSELEDKYKEYKLNFYHGKNEDFPSKLLRDIIEENLSYGSEKEKATNERLVEPLMNLLKSYEGGRESHAHFVVKSLFEEYLTVEELFSDGIQSDVIETLRHQHSKDLQKVVDIVLSHQGVRNKAKLVTALMEKLVYPNPGGYRDLLVRFSSLNHKRYYKLALKASELLEQTKLSELRASVARSLSDLGMHKGEMSIKDNMEDLVSAPLPVEDALISLFDYSDRTVQQKVIETYISRLYQPHLVKDSIQMKFKESGAITFWEFYEGHVDTRNGHGAIIGGKRWGAMVVLKSLESASTAIVAALKDSAQFNSSEGNMMHIALLSAENESNISGISSDDQAQHKMEKLSKILKDTSVASDLQAAGLKVISCIVQRDEARMPMRHTFLWLDDKSCYEEEQILRHVEPPLSTLLELDKLKVKGYNEMKYTPSRDRQWHIYTLRNTENPKMLHRVFFRTIVRQPNAGNKFRSAQISDAEVGCPEESLSFTSNSILRSLMTAIEELELHAIRTGHSHMYLCILKEQKLLDLIPFSGSTIVDVGQDEATACSLLKSMALKIHELVGARMHHLSVCQWEVKLKLDCDGPASGTWRVVTTNVTGHTCTIDIYREVEEIESQKLVYHSASSSAGPLHGVALNNPYQPLSVIDLKRCSARNNRTTYCYDFPLAFETALQKSWQSNGSTVSEGNENSKSYVKATELVFAEKHGSWGTPIIPMERPAGLNDIGMVAWIMEMSTPEFPNGRQIIVVANDITFRAGSFGPREDAFFETVTNLACERKLPLIYLAANSGARIGIADEVKSCFRVGWSDEGSPERGFQYIYLTEEDYARISSSVIAHKLELDSGEIRWIIDSVVGKEDGLGVENIHGSAAIASAYSRAYEETFTLTFVTGRTVGIGAYLARLGIRCIQRLDQPIILTGFSALNKLLGREVYSSHMQLGGPKIMATNGVVHLTVPDVLEGVSNILRWLSYVPANIGGPLPITKPLDPPDRPVAYIPENTCDPRAAICGVDDSQGKWLGGMFDKDSFVETFEGWAKTVVTGRAKLGGIPVGVIAVETQTMMQIIPADPGQLDSHERSVPRAGQVWFPDSATKTAQALLDFNREGLPLFILANWRGFSGGQRDLFEGILQAGSTIVENLRTYNQPAFVYIPMAGELRGGAWVVVDSKINPDRIECYAERTAKGNVLEPQGLIEIKFRSEELQDCMGRLDPELINLKAKLQDVNHGNGSLPDIEGIRKSIEARTKQLLPLYTQIAIRFAELHDTSLRMAAKGVIKKVVDWEESRSFFYKRLRRRIAEDVLAKEIRQIVGDKFTHQLAMELIKEWYLASQATTGSTGWDDDDAFVAWKDSPENYKGHIQKLRAQKVSHSLSDLADSSSDLQAFSQGLSTLLDKMDPSQRAKFVQEVKKVLD

SEQ ID NO: 96885 - protein, 405 aa, Zea mays
  misc_feature: Useful for making plants with modulated endosperm cell number
  misc_feature: Useful for making plants with modulated endosperm size
MERVFSVEEIPNPYWVPPHPQSAAAGAVAAPAGEAAGLMNRCPSEWYFQKFLEEAVLDSPVPVAGVSRGSVGAGVEAAERKTPGTAAAAAASSSVVDPVEYNAIVKQKLEKDLAAVALWRASGAAPPDNSPAGSSLPSVDVPHAGPLKPMGGTGSLVQNKLAGAPGGGSSPHVVQNADIPVKQTTSSSSREQSDDDDMEGDAETTGNGNPVQQRLQRRKQSNRESARRSRSRKAAHLNELEAQVAQLRVENSSLLRRLADVNQKFNEAAVDNRVLKADVETLRAKVKMAEDSVKRVTGMNTLFPAVSDMSSLSMPFNGSPSDSASDAAVPIQDDLNSYFANPSEIGGSNGYMPDIASSAQEDDDFVNGAQVAGKMGSTDSLQRVASLEHLQKRMCGGPASSGSTS

SEQ ID NO: 96886 - protein, 298 aa, Oryza sativa
  misc_feature: Useful for making plants with modulated silicon content
MASNNSRTNSRANYSNEIHDLSTVQNGTMPTMYYGEKAIADFFPPHLLKKVVSEVVATFLLVFMTCGAAGISGSDLSRISQLGQSIAGGLIVTVMIYAVGHISGAHMNPAVTLAFAVFRHFPWIQVPFYWAAQFTGAICASFVLKAVIHPVDVIGTTTPVGPHWHSLVVEVIVTFNMMFVTLAVATDTRAVGELAGLAVGSAVCITSIFAGAISGGSMNPARTLGPALASNKFDGLWIYFLGPVMGTLSGAWTYTFIRFEDTPKEGSSQKLSSFKLRRLRSQQSIAADDVDEMENIQV

SEQ ID NO: 96887 - protein, 190 aa, Brassica napus
  misc_feature: Useful for making plants with altered carotene content
  misc_feature: Useful for making plants with altered lignin content
  misc_feature: Useful for making plants with altered terpenoid content
MAEVMLPMKMEMANDPSKFTSPDLLHVLAVDDSHVDRKFIERLLKVSSCKVTVVDSATRALQYLGLDVNEKPIGCKDLKVNLIMTDYSMPGMTGYELLKKIKESSAFRDVPVVVMSSENILSRIDRCLEEGAEDFLLKPVKLSDVRRIRDSLIKVEDLSFTKSINKRELETENVYSLDSSVPLQLKRTKI

SEQ ID NO: 96888 - protein, 513 aa, Arabidopsis thaliana
  misc_feature: Useful for making plants with modulated biomass
  misc_feature: Useful for making plants with modulated heat sensitivity
  misc_feature: Useful for making plants with modulated seed number
MFETEHHTLLPLLLLPSLLSLLLFLILLKRRNRKTRFNLPPGKSGWPFLGETIGYLKPYTATTLGDFMQQHVSKYGKIYRSNLFGEPTIVSADAGLNRFILQNEGRLFECSYPRSIGGILGKWSMLVLVGDMHRDMRSISLNFLSHARLRTILLKDVERHTLFVLDSWQQNSIFSAQDEAKKFTFNLMAKHIMSMDPGEEETEQLKKEYVTFMKGVVSAPLNLPGTAYHKALQSRATILKFIERKMEERKLDIKEEDQEEEEVKTEDEAEMSKSDHVRKQRTDDDLLGWVLKHSNLSTEQILDLILSLLFAGHETSSVAIALAIFFLQACPKAVEELREEHLEIARAKKELGESELNWDDYKKMDFTQCVINETLRLGNVVRFLHRKALKDVRYKGYDIPSGWKVLPVISAVHLDNSRYDQPNLFNPWRWQQQNNGASSSGSGSFSTWGNNYMPFGGGPRLCAGSELAKLEMAVFIHHLVLKFNWELAEDDKPFAFPFVDFPNGLPIRVSRIL

SEQ ID NO: 96889 - protein, 92 aa, Triticum aestivum
  misc_feature: Useful for making plants with modulated nitrogen use efficiency
  misc_feature: Useful for making plants with modulated seedling growth
MSSRRSRSRQSGSSRITDEQISDLVSKLQDLLPEARLRGNDRVPSSRVLQETCTYIRSLHREVDDLSERLSELLATSDMSSAQAAIIRSLLM
